United States Patent 11,098,302 (IDENTIFICATION OF POLYNUCLEOTIDES ASSOCIATED WITH A SAMPLE) - sequence listing, part 43

SEQ ID NO: 145705 - DNA, 611 bp, Homo sapiens
  misc_feature: GYAE6OF01D74OC.21.4.A04.1.454.CMB.1.raw
  modified_base (365)..(365): a, c, t, g, unknown or other
  misc_feature (365)..(365): n is a, c, g, or t
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
  modified_base (490)..(490): a, c, t, g, unknown or other
  misc_feature (490)..(490): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttccttgttgttattttacaggtgtccagtgtgaggtgcagctggtggagtcgtgggggagacttggtcccaggcctgggacgggtccctgagactctcctgtgcagcctctgcattccaccttcagtcgacccacaacatggacgtggggtcccgccaggcctccgaggggagggctgggaggtgggccgcgtatacgaaggaacgctaanagttacagtacagaagtacggcncgtactggagaaagggtagttcaccatctanaagagatgattacgaaagtactcaacttgtatctagactaaatgaaactacgtaccctaaggaaaacccgnggaacccgtacgggtacccgttaggttagtttaacgtttaggtaaggggttaaacgaactaaaaagggaggttagggaacgtttagggttagggttagggtaacgtcggtttgggtaaccg

SEQ ID NO: 145706 - DNA, 626 bp, Homo sapiens
  misc_feature: GYAE6OF01B3YIO.21.4.A04.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagacttggtccagccgtgggacgggtccctgagtactctcctgtcgcacgcctntgctattcaccttnagtcgaccacaacatcggactcgggtccnccaggcctccgagggaacggggctgggaggtcgggtcggccgttagtaacgaaaggaagctaaacgagttacagtacagaagtacgcgcgtctggtagaaaggtagtcacatctacaagagatagtataacgaaacgtacacgtactgtaactctacgaactaaagtacgaaacacggtaacccgtaacggaaaaccgacgggaacgaacccgggtcgtaagtttaaacgtttacgttagggtaacgggtaagaaacggtaaaaggtcggtagggtacgttaggggtaggtagggtaacgtcgtaggtaccgg

SEQ ID NO: 145707 - DNA, 807 bp, Homo sapiens
  misc_feature: GYAE6OF01C785O.21.4.A04.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggcctcccaggctacaacgaaaccaccggaagaaattgtgttgaccgcagtcctcaggcctacccgtgttctttgctaccggaaggggaaacncgcccaccctctcctgcacgcctaccacgacctaagtaaatacaccgaagtacgtacctaactaacacgttacgcccgttacggtaaccaggaccgaacggaacggtcccgtacggacccgaacggtccctcccggtaggtttccctacacttcgtacgtcggcgttccggaccacggacggcctacggtcgaccacgtccgaagaccgtaggttcgaggtgacgtaggtcggtacgtacggaactacggtcttacgactatactaacgtagtaacgtacgacgtacggtacgtaggtaccgtaccgtaaagggtaacgttaccgtttacggaacgtttaacggtttacgtttaaccgttacggttacggtaaaccgtacggttagttaaacgggttacggtttaacggggtaaaccctttcccgttaaccgtttaccgggttacgggtttaaaccccgggttaccgggaaaacccgggtaaaacggggtaaaaccgttaaaacgggtaaaagttaaaccggtaaacgggaaacccggtttaggtcgggttacccgaacggttaccgaaccctaacgttaccgtcggttttaacg

SEQ ID NO: 145708 - DNA, 683 bp, Homo sapiens
  misc_feature: GYAE6OF01B5OYZ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctggttttccttgttgttattttacaaggtgtccagtgtgaggtgcagcgtggtggagtcgtgggggagacgttggtccagccgtgggacgggtcccctgacgactctcctggtgcagcctctgcctattcctaccttcagtcgacccaacaacagtcggacgtcgggtcccgccgacggcctaccggaggggaacggggcgtaggggaggtcggggtccggaccggttataacgaaggaaacgcgtaaacgagttaacaacgtaacaaggtaacgtaccgggcgtcgttcgtaggtaggtaaacggggtacggttaccaaccgtacgtacctacgaaaggtagtaagtagtaactttaacaaaacgtaaccttaccgtacgtagttactcgtagtaactaaatagaaccgaacgtaccgtaacggaaaaccggacggaacccgtaacgggtccgttaagttaacttagtttagggtacggtaagaaacgtaaaaggtggtaaggtagtgggtaggttagggtagtcgtggtacgg

SEQ ID NO: 145709 - DNA, 791 bp, Homo sapiens
  misc_feature: GYAE6OF01EDTMY.21.4.A04.1.454.CMB.1.raw
  modified_base (265)..(265): a, c, t, g, unknown or other
  misc_feature (265)..(265): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggacgggtccctgagactctcctgtgcagccctntgcattcctaccttcagtcgaccacaacagtggacgtcggggtccgaccgaggcctaccggagggggaacggggtcgtggggtaacgggtcgggggtccgggtaccggtttaacgttaaaccggaaaacggggaaaacgtaccgttaaaacgtaacggtttaaaccgaaagggttaaaccgaaaggtaaaacgttaacccggggcccggtacgggttcgttaagggtaagggaaaaacgggggtaacgttacccgaaacccgtaacgttaccgtaacgaaaaggaacgtaattaggtaaacttaacgaaaaacggtacctaactacttaggttaactacgtagaactaaaacgtcggaaaccacggtaaccgtaaacggaaaaacccggcgggaaacccgtacgggtaccgttagttaaacgttttaggtttacggtagggttaaacggaaacggtaaaaagggtcggttaacggggtaggtttacggggttaggggtagggttacggtggttaggtaaacccggg

SEQ ID NO: 145710 - DNA, 882 bp, Homo sapiens
  misc_feature: GYAE6OF01AMJUJ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggatacgttggtccaggccgtgggacgggtccctgacgactctccgtgtgcagcctctgctacttccaccttcaggtcgaacccaacaaaccagtacgggtaccgtcggggtcccgaccgacgggtcccgtacccggaagggggaacgggggtccgtagggacgggttcgggggtccgggtacccgttaagttaaccggaaaagggtaaacgtaccgttaaaacgtaaggtttaaccgaaggttaaacgaaggtaaacggtaccgggtcggtaccggttagttaacgggtaagggtaaaacgggggtaaccggtttacccaaaacccgttaacgttacccgttaacccggaaaaaggttaacggtaacgttaacggttaaaaccgtttaaccgaaaaaaccgttaacccgttacccgtaaaacggtttaccggtttaaaccgttccgtttaaacggaaacctaaaaggttaaccggaaaaacccgtaaccggtaaacccgggttaaacggaaaaaaccccgggtaacgggtaaccccgaaaccggggttacccgtttaaggttaaacgtttaacggtttaggggttaaacgggttaaacgaaaccggttaaaaggagggttacgggtaagttaggggttaggggttaggttagtcggttaaggtaaccg

SEQ ID NO: 145711 - DNA, 823 bp, Homo sapiens
  misc_feature: GYAE6OF01BY5GH.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttagacgcagtctccaggccaccctgtctttgctccgagggaaancgccacctctcctgcacgcctaccagccaagaactactccagacgactaactacaagtacgcctggtaacccagacaaggaacgtccctgggaccacggtcctaccccgtaggtttccctacgtacttctagtccggtccgttccgggtaaccccaggaccgggtacccacggttcggaccctaaccgtccccgaaggaaccggttacggttaccgacgggttcgggaccgtaagggttcggggtaccgtacgggggaacctaacggttaccgtttaccttaaccgtccctactaacttacgtaagttacggacgtaacggtacgttacgggacggttacccgtaaggtaaacgtttccgtttaacggacgttaacgttttacggttaacttttaccggttcgtaacgttaacggtaccgttaagggtttaacggtaacgggtttaacgttaccccgtttaaccgtttcggttccgggttaacccggtttacccggggaaccggtaaaacggggtaaacccggtaaaagggtaaaccgaaaacggttaaccgggtaaaacgttaacggttagggtacggtacccgtaggtaaccccgtaacttacggttcccgtttaacgg

SEQ ID NO: 145712 - DNA, 641 bp, Homo sapiens
  misc_feature: GYAE6OF01BZ6AX.21.4.A04.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaancgcccacctctcctgcagctccagccagaatactccagacgctaactacatacgcctaggtaccagcgaagaacgccgtggaccaggcctccccgtaggttcccncactctagtcgcgtcggtaccacgcgggccacgtggcacgtcccagtaccgtacggttcaggtcgtcgtaggtcgggtcggtagggaacacggtacctttcgaccttccgtactagttactaagttacgacgtaaggacgttacggacgtaccgtaaggtaacgttacgtttcgacgtagttacgttacgtttacgtcgtactagtactaattcgtaccgtacccgtacccctaccccgtactaccgtacccggtaccggaccggtaacgggaccaccggtacgtacgagtacgaacgtaacgaaaccgtacgtcggtagtccgtcgacccgtaacc

SEQ ID NO: 145713 - DNA, 742 bp, Homo sapiens
  misc_feature: GYAE6OF01A5U5C.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttggttttccttgttgttattttacaaggtgtccagtgtgaggtgcagcgtggtggagtcgtgggggagtacttgggtccaggccgtgggacgggtcccctggacgacctcgtcctgtcgcacgcctctgcctattccaccttcaggtacaccaacaacgngttacggacgtcggggtcccgccgacggcctaccggaggggaacgggcgtagggtcgggtcggggtaccgggtaccggttaacgttaacgaaaagggtaaactaccgtaaacgtaggttaaccaagtaaccgaagtaacgtacggcgtcgtacgtaggtaaggaaacgggtacggtcaaccgtagtaccagaaaggagtagttacgaactaacgaaaacgtaaccttacgtaacttcgttaactacgttaacgaacgttaaaagtacgaaaccgtacgtaaaccgtaaaccggaaaaccggaacgggaacccgtaaccgggtaccgttaagtttaacgtttaacgggtttaggtaacgggttaaagaaaacggttaaaacggaggtttagggaacgtttagggaggggtttacggtacggtacgttgggtaacg

SEQ ID NO: 145714 - DNA, 714 bp, Homo sapiens
  misc_feature: GYAE6OF01EMOF4.21.4.A04.1.454.CMB.1.raw
  modified_base (271)..(271): a, c, t, g, unknown or other
  misc_feature (271)..(271): n is a, c, g, or t
  modified_base (581)..(581): a, c, t, g, unknown or other
  misc_feature (581)..(581): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagagactcaccatggagtttgggctgagcttgggtttttccttggtttgtttattttacgaaggtgtccagtgtgaggtgcagcgtgggtggagtcggtgggggatacgttggccagccgtggacgggtcctgacgctctctgtgcagcctntgctattccaccttgacgtcgaaccaacgaactagtcgggaccgttccggggtaccccgaccgacgggtaccccgtaccggggaagggggggtaaccgggtccggttaggggtaacgggttccgggggtaccgggtacgttaacggttaaaccggaaaaggggtaacttaaccgtaaacgtaacggttaaccgaaggttaaccaaggtaaccgtaccggggcgtcgttacggtaggtaacgggtaaagggtacggtaccaacctagtctaacgaagagtactagtaactaagaaacgtaactactacgtnttacgtctagacaagactaacgacgtaacgtaacggaacgacggaccgacggtaccgttagttaacttaggtagtaggttaacgaaacgtaaaggtaggtggtaagttcgggtaggtaggtagtgtggtaacg

SEQ ID NO: 145715 - DNA, 826 bp, Homo sapiens
  misc_feature: GYAE6OF01DSGF0.21.4.A04.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagagtagtgatcaggggagctctgagagcggacgccccagccccagaattcccaggttgtttcatttggtgatcagcactgaacacagaggactcacagtggtagtttggctgacgtcgtttcgggttttcctttgtttacgtttattttaacgaaggttcgtccgtagtggtgaggtgacngtcgtgggtggaggtcggtggggaatcgtcggtccagtccgtggtacggtcctgacgtctctccgtgtcgcacgtcctctacgtacttacttaccgtaccgttactaacggtacgtaacccaacgtaaacgtcggtacggaccgttccggggacccgacccgtacgggtaccgtacggggaacggggtaacgggtcgtacggggtagggttccggggtacccggtaaccggttaagttaaaacggaaaacggtaaacgtacgttaaacgtaaacgttaacgtaacgtaaacggaacggtaaacgtacgggccgtacgttgtaaggtaaacgggtaaacgggttaaacgtccgaaaccttacgtaacgtaacggaaagtaacgacgttaagtaactaacgaaactaacctgtaacttggtaaacctgttaacgaactaaacgtacgaaaccgtacgtaacctaaaaccgggtaaacggaggtaacccgtaacgggtaccgttagttaaacgttaagttacgggtaaacggttaaaacggaaaacggttaaaagggcggttaaaggtggtttaaacggggtggttaaagggtacgtaccgggttataaccggg

SEQ ID NO: 145716 - DNA, 863 bp, Homo sapiens
  misc_feature: GYAE6OF01D6699.21.4.A04.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaattgtgttgacgcagtcctccgaggcctacccttgttcctttcgtcctaccgaaggggaaanccgccctaccctctcctgccacgcctaccacggcccaagtaactacgtaccgaggactaccttaaactacaagttacgacccgtaggtaacccaggaccgaaggaaccgccggtacggccgacggcccttcccgtaaggtttcccactacgttctagtccggcgttaccgggaccccaggaccgggtaccctacgtcgggacctaaccgtccccgaaggtaccgtacgggttacagggttcggacgttaggggtacgggtacgtagggaacctaggtacccttcaccgttactacgtaacttacgtaagttacgacgtaacggtacgttacggaaccggttacgtaacggtaacggttactttccggaagttacggtttaagtttaaccgtttacggttcgtaaccgggtacgttaacggttacggtttaacgttaaaccgggttaacgtttaacccgttccggttttaccggtacccgggtttacccggggttaaccgggtaaacccgggtaaaaaccgggtaaaccggttaaaacggggtaaacgttaaaaacggtaacccgggttaaaaaccgttacggggttaacggtacccgggttaaccgtaaccggtaacccctaaccggtttagttccccgtttttaaccgg

SEQ ID NO: 145717 - DNA, 703 bp, Homo sapiens
  misc_feature: GYAE6OF01DUQMA.21.4.A04.1.454.CMB.1.raw
  modified_base (194)..(194): a, c, t, g, unknown or other
  misc_feature (194)..(194): n is a, c, g, or t
  modified_base (319)..(319): a, c, t, g, unknown or other
  misc_feature (319)..(319): n is a, c, g, or t
tcagtcgtcgctcgcacgaccggtgctcgatttagagtagtgatcaggggagctctgagagcggacgccccagccccagaattcccaggttgttttcatttggtgatcagcactgaacacagaggactcacctagtggtagtttcgggctgagtcgtttgggttttccttgtttgtttacttttacgaaggttntccagttgtgaggtcgacgagtcgtgggtggagtcggtgggggactcgttggccaggtccgtgggacgggttcccaggactccttcgtccgtggtcgactcggccctgtagctattccaccgttnaggtacacccaagaactggtcggccgttcgggcccaccgaggtcctacgggaaggggaacgggtctgggaggttcggggaccgtaaccgttaagaaccggaaaagggaactctaaaacgagttaacagtaaacgagtaaacgtccggacgtcttcgaaggttacggaaaagggtcgttacaactacgttacaagaaggatatacggaattaaccgaaagtactctagttagtactctagaactaaagtaccaagaccgtaacggaaacgaaaccggagaccggtaagtccttaagttacgttagtagggttaacgtaagaaaaccgttaaagggtggttaaggagttaccgggtagggttaagtttcgaacgttggtaaacccg

SEQ ID NO: 145718 - DNA, 697 bp, Homo sapiens
  misc_feature: GYAE6OF01E03QV.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaactactccagacgctaactacatacgcctggtaaccagcaagaacgccgtcggacccagggccctccccgtacggtttccctactactccttagtcggccgttcggggtaccccaacgacgggccctaccgtggacctactcccgaagacgtacggttacgaggtcgggacctagggttcgggtacgtacggggactacggtaccttccacttcgtacaattctaagttacgacgtaggtacgtaggacggtaccgttaggtaacgttacgtttacgacgttaggttacgttacttacgttgtacgtagtcgtaagttacgtaggtaacgtttcctaccgttcgttacggttaccggttaccgggtaaccggtaaacgggaaccgttaaagggtaaacgtaaaagttaacggaaaaccggtaacggttaggtacggtacgtacggaacctaaccgtagttcgttacg

SEQ ID NO: 145719 - DNA, 733 bp, Homo sapiens
  misc_feature: GYAE6OF01CAJ8M.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccacctgtctttgtctccgaggggaacncgccacctctcctgcagcctccagccagaatactccagagtctactacagtacgcctggtaccagacaaggaacgtccgtagggaccacgggtcccttaccccgtaacggtttccctacgtacttaccgttacgtcggtacccgttaccggggttaccccaacgggaaccggggtcccctaacggttcgggaaccctaaccgttaccccgaaggtaaccggttaggttaccagggttcgggacgtaggggttcgggtacgtagggactacgtacttcgactcgtactatacgtagttacggacgtaagtacgtacggacgtacgttaaggtaacgttactttacggagttacggtttagttaactttacgtcgtaacgacggtcgtaaggttcggtaagggttaccttaccgtacgttacggttacggttaccggttaccggaaccggtaaacgggtaaccgtaaagggtaaacgtaaagtacggtaaaccgtagttcggacggtacgtacggaccctaacgtgtcggttacg

SEQ ID NO: 145720 - DNA, 855 bp, Homo sapiens
  misc_feature: GYAE6OF01COP2D.21.4.A04.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (409)..(409): a, c, t, g, unknown or other
  misc_feature (409)..(409): n is a, c, g, or t
tcagtcgtcgctcgcacgaccggtgctcgatttagagtagtgatcaggggagagctgctcagttaggacccagagggaaccatggaaaaccccagcgcagcttctcttcctcctgctactctggctcccaggctcagaaaccaccggagaaattgtgttgacgcagtctcaggcaccctgtctttgctccaggggaaancgccaccctctcctgcagcctccagccagaatacnccagagcctactacagtagcctggtaccagcagaacgcctggccaggcctccccgaggttccctcacttctacgtcgccgttcgggtaccccagtacggggcccaacgttcgggcctacgtccccaaggtacctacgggtttacaggttcgggtaccgagggttcgggggttacngggggaacctaacgggtacctttccgaaccgtttcctacgtaactttaccgtaagttttacggaaccgtaacggtaaccggttaggggtaaccgtacccggttaaacgggttaaacggttacgttttaccgggtaaccgttaaggttttacggtttaaccgtttttaaccggttacggtttaacccgaacgggtaacgttaacggggtttaaagtttaaccggggttaaaccgttttacccgtaacccgttttaccggtttaccgggtttacccgggtttacccggggaacccgggttaaaaaccgggggaaccccgttaaaaagggggttaaaccgttaaaaacgggttaaacccggtaaaaaaccgggttaaccggtttaacgggttaacgggtcccgttaacgggtaacccctaaaccccgttaagttcccggttttaacccg

SEQ ID NO: 145721 - DNA, 730 bp, Homo sapiens
  misc_feature: GYAE6OF01BLI74.21.4.A04.1.454.CMB.1.raw
  modified_base (210)..(210): a, c, t, g, unknown or other
  misc_feature (210)..(210): n is a, c, g, or t
  modified_base (260)..(260): a, c, t, g, unknown or other
  misc_feature (260)..(260): n is a, c, g, or t
tcagtcgtcgctcgcacgaccggtgctcgatttagagtagtgatcaggggagagctgctcagttaggacccagagggaaccatcggaaaccccagcgcagcttctcttcctcctgctactctggctcccaggctcacgaaaccaccggagtaaattgtgttgacgcagtctccgaggccaccctgtctttgtcctaccgaaggggaaacncgaccctaccccttctccgtgcagcctccagaccagaatactaccagacnctactacatacgctacgaccagcagacgcgtcgaccagcctccgtacgttccatactctagtcgccgttcgggacccaggaccggcctacgcggtacctacgtacccgaggacgtacggttacgacgggtcgaccgtagggttccggggtacggtaacggggtaacctcgggttaaccttcgtaacccgttactacgttaacgttacctaaggtttaccgacgtaacggtacggtttacggaaccgtccgtaaaggttacggttaccgtttaccggagttacggtttacgtacgtttacgtacgtacgtacgtaacgtacggttaagtaccggttaacgttaccttacgttcggttaccgtacccgggttacggtaccgaaacggggttacctaaaagggtacgtaaagtaacggtaaaccgggtacgtcgggtaacgtcgtacgtaacctacgttcgttacgttaccgg

SEQ ID NO: 145722 - DNA, 690 bp, Homo sapiens
  misc_feature: GYAE6OF01BSYQ4.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaanacgccaccctctcctgcagcctccagccagaactactaccgagacgactaacctaacagtacgccgttacggtaaccagacaaggaacgccgtggcccgaaggccctccccgtacggttccctactacttctagtcgtccgttcgggtacccacggacgggccctacgtcggacctaccgtacccgagaccgtaggttcgaggtcgggcgtagggttcgggtcgtagggaacctacgttacttccacgttctactacttctagttacgacgtacggtacggtaggacgtcgttaagtaacgtttcgtttaccgagttaacggtttgttaacttacgtagtacgagtacgtaggttacgtacgggttacgttacctacgttcgtacggttccggtaccggaaccggtaaacggaaccgttaaaggtaaacgtaacgttaacggaaaccgtacgttgggacgtcgtacggtacctaacctgttcgttaaccg

SEQ ID NO: 145723 - DNA, 767 bp, Homo sapiens
  misc_feature: GYAE6OF01A4F31.21.4.A04.1.454.CMB.1.raw
  modified_base (644)..(644): a, c, t, g, unknown or other
  misc_feature (644)..(644): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtcccaggcccgtgggacgggtccctggagactctcctgtgcagcctctgctattccaccttcgagtcaaccacaactagtcggacgtcgggtacccgccgacggcctaccggaagggggaacggggtccgtaggggtacgggttcggggtaccgggtacccggttaagttaaccggaaaagggtaaaccgtacgttaaaaccgtaacggtttaacaacggttaaaccgaaggtaaacgtaccgggaccgtacggttcgtaagggtaagggtaaaagggtaacggtttacccaacccgtaattaccgtaacgaaaaggtacgtaagttagaaacttaaccgaaaagtaaccctacgtaacttgttaacttcgtagaactaaagtacgaaaccgtacggtaccgtaaacgaaaacccgggnggaaccgaccggggtaccgttaagtttaacgtttaacggttagggtaacggtaaacggtaaacgaaaagggttaggtaagggtaacgttggggtagggtttaagtcggtcgttaagggtaccg

SEQ ID NO: 145724 - DNA, 691 bp, Homo sapiens
  misc_feature: GYAE6OF01EQWCH.21.4.A04.1.454.CMB.1.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacgganaaattgtgttgacgcagtctccaggcaccttgtctttgtctccgaggggaacgngcccacctctccngcacgctccagccaagaatactccgagacgctactacatacgcctaggtaccaggcaaggaacncgtcggaccaggcctacccgtaggttcccncacttctagtcgcgtccggtacccacggacggccacgtcggacctacgtccgagacgtaggtcaggtcggcgtaggtcgggtactgggactacggtacttcaccttctacattactacgttacgacgtacgtacgtagggtactaccgtaaggtaacgttacgtttacggacgttacggtttacgtttaacttacggtacgttacgtaacgtagttaacggttaaggttacggttaacgtttacctaccgttcggttacggttaccgggtaccggtaaccggtaaacgggtaaccggttaaagggtaaacgtaaaggtaacggtaaaacggttacgttacgggacggttacctacggtaaccaccggttacgtcgttaccgg

SEQ ID NO: 145725 - DNA, 779 bp, Homo sapiens
  misc_feature: GYAE6OF01B8RZL.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgacgactctcctgtcgcagcctctgctattccaccttcagtcgaaccacaaccagtcggacgtcggggtcccgccgaggcctaccggaagggggaacggggccgtgggacggttcggggtccgggtaccgttaagttaaccgaaagggtaaacgtaccgttaaacgtaacggtttacgaacgttaaaccgaaggtaaacgtacccggggacgtaccggttacgtagggttaaggaaaaacggggttacgggtttacccaaacccgtaagttacccgtaacggaaaaggaggttaacttacggtaaactttaacgaaaaacggtacctaccctaacgtttagtaaacctcgttagaacgtaaaacttcgaaaaccgtacggtaccccgtaaagggaaaacccgtggggaacctacccggggtccgtttaagtttaaacgttagggtttagggacgggtttaaaacgaaaccgtaaaaagggtcggttagggaaagttgggtttaagggggtacggtttacgtcggttagggtaacccg

SEQ ID NO: 145726 - DNA, 720 bp, Homo sapiens
  misc_feature: GYAE6OF01EGZYX.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttatcttcctcctgctactctggctcccaggctcagaaaccaccggagaaattgtgttgacgcagtctccaggccaccctgtctttgtctccgaggggaaanacgcccacccctctcctgcagcctccagccaagtaactactccaagacgccttaactacattacgcccttaggtaacccagcaagaacgtccgtaggcccaggtccctcccgtacggtttcccactattccgttagtcggccgttccggggtaccccacggacgggcccacggttcgggacctaaccgtccccgaagtaccgtaggtttccgagggtcggaccgtagggttcgggtacgtcggggaacctacggtacctttcgaacttcctacgtacttactacgttacggactacggtacgtacgggactaccgtaggtaacgttacgtttaccgtacgtaggtttacgttaactttacgtacgtacgtagtacgtaaggttacgttacgggttaacgtttacctaccgttcgttaccgggttccggttacccgggaacggtaaacgggtaaccgtaaagggttaacgaagtaacggaaacgtaagttggtacggtctacggaccactgtcgttacg

SEQ ID NO: 145727 - DNA, 689 bp, Homo sapiens
  misc_feature: GYAE6OF01EAIA7.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgttctttgtcctccgaaggggaaacgcgcccaccctctcctgcagcctccagccaagaatactccagacgctactacatacgcctaggtaccagcagaacgccgtcggccacggtcctcccgacggtttcctactatcgtagtcggtccgtccgggtacccacgacgggccaacgtcggacctacgtacccgagaccgtaggttccgaggtcggacgtagggtcgggtcgtacgggactacgtacttcacgttctacgattactaagttaccgacgtagtacgtaggtacgtacgtaggtaacgttactttaccggagtaaggtttgttaagtttacttcggtacgtacgtacgtaagttagttacgggtactttcctaccgtttcgtacggttaccgggtaccgggaaccggaaacggggtaacgtaaagggtaaacgtaaacgttacggaaaaccggttacgttgggtaccggtacttaccgaaccgtaaccgttcgttcgttaccg

SEQ ID NO: 145728 - DNA, 674 bp, Homo sapiens
  misc_feature: GYAE6OF01B3T1A.21.4.A04.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctcgagggaaancgccaccctctccngccagcctccagccagaatactccaagagctaactacagtagcctaggtaaccagccaagaacgcctggaccaggcctacccgtaggttcctactatctatcggcgtcgggtacccacgacgggcctaacgtcggacctaacgtccccgaagtaccgtaggttcaacggtcggacctagggtcgggtctagggaactagtaccttacgacttctacgtatactagttaagctagtaccgtggtacgaccgtaagtaacgttacgtttacggacgtaagttagttacttaacgtcgtacgtacgacgtaaggttagtacggggttaactttccctaacgttacgttcgtaccggttaccgggaaccggtaaacgggtaaaccggtaaaggttaacggtaaaacgtaacgggtaaaactacgttaggtaccgtacgtacgaacctaaccgtagttcgttaccgg

SEQ ID NO: 145729 - DNA, 750 bp, Homo sapiens
  misc_feature: GYAE6OF01CJXID.21.4.A04.1.454.CMB.1.raw
  modified_base (197)..(197): a, c, t, g, unknown or other
  misc_feature (197)..(197): n is a, c, g, or t
  modified_base (728)..(728): a, c, t, g, unknown or other
  misc_feature (728)..(728): n is a, c, g, or t
  modified_base (738)..(738): a, c, t, g, unknown or other
  misc_feature (738)..(738): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctcgaggccacctgtctttgctccgagggaanacgccacctctcctgcaggtctccgagccaagaactacgtccgaagcgtacctaacgtacaagttacggcccgttacgggtaacccaggaccaaaggtaaccgtcccgtaggggaccccgtaacggggtccccttaccccggtaccgggtttacccctaccgtaaccggtttacccttaaggtttccgggtaacccgggttcccgggttaacccccgaacggtacccgggggtaccccctacggttcgggaccccttaaacggtcccccgaaaggaccgtttacgggtaccgaacgggttcgggacggttaggggttcgggttacgtacggggaactacggtaccctttcgacttcgtactagtcagttacgcgtaacgtcgtaggacgtaccgtaggtaacgttacgttacggacgttagttacgttaaccgttcgtacgtacgaagtacgtaaggttacgtacgttaacgtctaaccgttgtcggtaccgttcggacgtagaacgtaggaacgtaagtacgaacgtagngtcgtacgtnactctcgtgtcc

SEQ ID NO: 145730 - DNA, 761 bp, Homo sapiens
  misc_feature: GYAE6OF01A4PBX.21.4.A04.1.454.CMB.1.raw
  modified_base (289)..(289): a, c, t, g, unknown or other
  misc_feature (289)..(289): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggatacgttggtccaggccgtgggacgggtccctgacgtactcgtcctgtcgcagccctgtgctacttcacccttnagtcgacccacaactagtcggactcgggtacccgccgaggcctaccggaagggaacgggtctgggagggtcgggtccggaccggttaagttaaccgaaagggaaacgaccgtaaactagtttaacgaaggttaacaaggaacgtaccgggcgtccggtacgtaggtaacgggaaaagggtaaccggttccaacccgtagttacgtaacaaaggtacgtaatacgtaaacgttaaccgaaaacggtacctaccgtaaccgttagtaacttcgacgtacgaaacgttacgaaaccgacggtacccgttaaacggaaaaacccggtacggaaccggtaccgggtaacccgtttaggtttaaacgtttacgggtttacgggttaagggttaaaccggaaaacggtaaaagggttacgggttagggtaaggttacggggtttaggggttaaggttaacggtcggtttgggtaaaccg

SEQ ID NO: 145731 - DNA, 822 bp, Homo sapiens
  misc_feature: GYAE6OF01D5DOQ.21.4.A04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtcagtgtgaggtgcagctgggtggagtcgtgggggatacgttggtccagtccgtgggacggtcccctggacgtactctcctgtcgcacgccttcgtcgcctaatttccgtaccctttacgaacgtcgaacccaaccaaacgtagttcgggaccgttcgggggttaccccnccggaggcccgtacccggggaagggggaacggggtccgttaggggacgggttccgggggtaccgggtacccgtttaaagttaaaccggaaaagggtaaaacgtaccgttaaaacgtaacggtttaaacgaacggttaaacggaaacggtaaacggttaacccgggcggtaccggttaccgttaagggtaacgggtaaaaacgggtaacgggtttaccaacccgtaacgttaccttaaaccggaaaggtaaaggtaacgtaacggttaaactttaacgaaaaacggtaacctaaccgttaacgttacgtaacgtttacgacgtaaactaaacgtaacgaaaccgtaacgtaccgttaaacgaaaacccggtaggaacccggaaccgggtccgttaagttaagtttacgttaggtaacggtaagaaacgtaaaaggtacggttaggtagttaggtaggtaggtaggtctaggtacg

SEQ ID NO: 145732 - DNA, 775 bp, Homo sapiens
  misc_feature: GYAE6OF01B1E5A.21.4.A04.1.454.CMB.1.raw
tcagtcgtcgctcgcacgaccggtgctcgatttagagtagtgatcaggggagctctgagagcggagccccagccccagaacttcccaggttgttttcatttggtgatcagcactgaacacagaggactcacagtggtagttgggctgagtcgttgggttttccttgttgttattttacgaaggtgtccagtgtggaggtgcagcgtgggtggaggtcggtgggggatcgttggtccgaggccgtggggaccgggtcccctaggtacgtaccttcctccgtggtcgccacggtcccttcgtacgcctattccctaaccgttcgaacggttaccaacccaactaacgtaggtccgggtacggtccgggtacccgccgtacggccgtaccggggaaggggacgggtcgtaggggtacgggttcggggtacgtacggttaataacggaaaggtaactacgtaaacgtagttaacgaacgtaacgaagtaacggtcggtacgtaccggttagagggtaacggtaaagggtacgttaccaaacgtacgttaccgtaaagaaagtacgtaagtactaattaaccgaaactaccgtataacgttagtactcgtaacgaacgtaagtacaacgttaaccggaaccgtaaaaccggaaacgggccgaaccggtaacggttccgttagttaaacgtttaggttacgggtaaacggtaaaggaacggtaaaaggtgggttaacggttagggttcgggtaagggttagggtacgttgtaaggttaacg

SEQ ID NO: 145733 - DNA, 754 bp, Homo sapiens
  misc_feature: GYAE6OF01CL9XH.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaaggggaaagcgcccaccctctcctgcacgcctccagccaagtaatactccaagacgctaactacatacgcctaggtaccagacaagaacgcctggaccaggtcctccccgtaggttccctacgtaacttcttagtcggtccgtaccgggtacccacggacgggacccacggtcggacaacgtcccgaaggtaccgtaggtttccgaagggttcggaccgtaggggtcggggttccgtaggggaacctacgggttaccctttacgtacccttccgtaccgtaacttaccgtaagtttaaccggaccgtaacggtaccggtacgggtaacgtaccgttaagggaacgtttaacgtttccggacgttaaggtttacgttaactttacgtacgtacgtaacggtacttaagggttacgttacgggtaacttacctaccgtttacgttaccgggttaccggtaccggaccggtaaaacgggtaaccgtaaagggttaaagtaaagttaaacggaaacggtacgttaggtacgtacgtacaaccgtaccttaacgttcgttaccg

SEQ ID NO: 145734 - DNA, 610 bp, Homo sapiens
  misc_feature: GYAE6OF01B4P02.21.4.A04.1.454.CMB.1.raw
  modified_base (202)..(202): a, c, t, g, unknown or other
  misc_feature (202)..(202): n is a, c, g, or t
  modified_base (318)..(318): a, c, t, g, unknown or other
  misc_feature (318)..(318): n is a, c, g, or t
  modified_base (601)..(601): a, c, t, g, unknown or other
  misc_feature (601)..(601): n is a, c, g, or t
tcagtcgtcgctcgcacgaccggtgctcgatttagagtagtgatcaggggagagctgctcagtttaggacccgagagggaaccatggaaaccccagcgcagcttctcttacctcctgctactctggctcccaggctcagaaaccaccggagaaattgtgttgacgcagtctcaggcacctgtcgtttgtctccaaggggaangccaccctcgtcctggccagcctaccgacgccagaactactccaagagcctaactacattacgccgtggtacccagccacggaacgcctggacccaggcctcccgaggttccctanactccttagtcgcgtcgggtcccacgagggcctacgtcggccactcccagtacgtggttcgaggttcggcgtaggttcgggtcgtacggggactaacggtactttccgacttctactatcgtagttacgcgtagtacgtggacgtccgtagaagtcgtttcgcgtagttagtacttacgtgtcagctagtagtacggtacttctacttcgtcgttcgttcggacgtaacgggtaccgaaaggtacgaaagtacggaaacgtacgtgtacggactacgactacngttcgttcg

SEQ ID NO: 145735 - DNA, 884 bp, Homo sapiens
  misc_feature: GYAE6OF01EOM7F.21.4.A04.1.454.CMB.1.raw
tcagtcgtcgctcgcacgaccggtgctcgatttagagtagtgatcaggggagctctgagagcggagccccagccccagaacttcccaggttgttttcatttggtgatcagcactgaacacagaggactcaccagtggtaggtttgggctgagtcgttgggtttttccttgtttgtttattttaacgaaggttcgtccagttgtgaggtgcagcgtggtggaggtcggtagggggagtacgtttcggtccacggccgtacggggaccggggtccccgtaagaccttcctccgttggtcacgacgtccctcgtcgacttacttccgtaccttacgagtcgaaccacaacgagtacggtacgtccgggtacccgccgtaggccgtaccgggaagggggaacggggcgtagggcgggttcggggtccggtaccgttaagtaacggaaaggtaaacgaccgtaaacgtaacgttaaccgtaagtaacgaaacggtaacgtaccgggtaccggtacgttcgtaagggtaaacggaaacgggtaacgtttacccaacgtacgttaacgtaacgaaaggtacgtaaagtacgtaaacgttaaaccaaaacggttaccctacgttaacgttacgttaactacgttaacgaaacttaaacgacgaaacccgtaacggtaaccccgtaaaacgggaaaaaccccgggagggtaaaacccccggtacggttaacgggtttaacggtttaaagttttacgggttaaaggggttaaacggtaaaaaccggtaaaaacgggaaaaagggttcgggtttaacgggggttaaaggttacggggtttaaagggggtttaagggtaccggtttaaccgggttaggtaacccgggttaaacccg

SEQ ID NO: 145736 - DNA, 691 bp, Homo sapiens
  misc_feature: GYAE6OF01E0O51.21.4.A04.1.454.CMB.1.raw
  modified_base (134)..(134): a, c, t, g, unknown or other
  misc_feature (134)..(134): n is a, c, g, or t
  modified_base (200)..(200): a, c, t, g, unknown or other
  misc_feature (200)..(200): n is a, c, g, or t
  modified_base (504)..(504): a, c, t, g, unknown or other
  misc_feature (504)..(504): n is a, c, g, or t
  modified_base (579)..(579): a, c, t, g, unknown or other
  misc_feature (579)..(579): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctccaggctnagaaaccaccggagaaattgtgtgacgcagtctccaggcacccttgtctttgtctcgaaggggaanactcccacctctcctgacacgctccagccaagaacttacgccagacgtctaactacaagtacgcctacggtacagacaaggaacgccgtcggacacgggccctccgtacggttcctacacgttcctaagtcggtcggtccggtacccaacggtacgggacctacgtggaccctacgtaccccgaaggaccgttaaggttaccgaaggtcgggacgtaacggggtttcggggtacgtacgggggtaactacgtaaccgtttcaactttcgactaacgttaccagttacgctaaagcgttggaacncgtaggaaattcgttacacgtgttacgtaatttccgtgacagtacgtaagtacgtaggtacgttacctaccgttntaccggtacggttccgggaaaacgtacgggtaaaccgtaaaggtaacaaaggttaacggaaaaccgtacggttggtaacggtacgttccaacgtactttagtccgttaacgg

SEQ ID NO: 145737 - DNA, 660 bp, Homo sapiens
  misc_feature: GYAE6OF01BO2LF.21.4.A04.1.454.CMB.1.raw
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
  modified_base (527)..(527): a, c, t, g, unknown or other
  misc_feature (527)..(527): n is a, c, g, or t
  modified_base (543)..(543): a, c, t, g, unknown or other
  misc_feature (543)..(543): n is a, c, g, or t
  modified_base (647)..(647): a, c, t, g, unknown or other
  misc_feature (647)..(647): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgttgttatttacaagtgtcagtgttaggtgcagcgtggtggagtcgtgggggancttggtccagccgtggtacggtcctgagtacctctccgtgtcgcncgcctcgtcgactacttcctacctttgagtaccgaaccaacaaacagtcgggtacgtcggggtcccgaccgacgggtccgtaccggaggggaacgggggtctagggtaacggtcgggtacggccgttaagtaacgaaaggtaaacgtcgtaaacgtaaggttacaagttacgaagtaacgtacgggacgcgtacgtggaagtaagggtaacggtacaacgtactcgtaacaagtagatagtaacgtaacaaagtactagaccttgtaactnttagaaactaacgtanaaccgtaagtaccgtaagaaaccgagaccgtaacgcgtttaagtaacttaggtcgttaaggtaacgaaacaaagggtgtaaggtataggggttacgtaggtaanccgttgtaagacg

SEQ ID NO: 145738 - DNA, 768 bp, Homo sapiens
  misc_feature: GYAE6OF01A6CV8.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggataaattgtgttgacgcagtctccgaggccaccctgttctttgtctccgaagggaaagcgccaccctctcctgcacgcctaccgacgtaccaaagtaacttactaccgaaggtacgtaccttaaactacgagttacgcccgttacggtaaccacgacgaacggaacgtcccgtcgggacccgtacggtcccttaccccggtacggtttccctactacgttccgttaagtccgtccggtttcccggggtaccccaacgggtaccggggtccctaacggtcggaccctaacgtacccgtaacgacgtacggtcagggtcgacgtaggtcgggtcgtacgggactacgtaccttcacgtactactatacgtatacgacgtacgtacgtacggacgtacgtaggtaacgttcgttacgtacttaggttacgttacttaacggttcgtactaggtaacgttaacggttagtacgggttaaccttccgtaccgtttcggtaccggttaccggaccggtaaacggtaacgggtaaaccgtaaagggttaaacgtaaacgtaaacggtaaaccggttaacgttacggtacggttacctaccgaaccgttacgttcgttaccttaccgg

SEQ ID NO: 145739 - DNA, 726 bp, Homo sapiens
  misc_feature: GYAE6OF01A8UVG.21.4.A04.1.454.CMB.1.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaactatggaaaccccagcgcagcttctcttcctcctgctactctggctcccaggctcaagaaaccacggagaaattgtgttgacgcagtctccaggcacctgtctttgctcgaggggaaancgccaccctctcctgcagcctccagccagaatactccagacgactactacatacgcctaggtaccagacagaacgcctaggccaggcctaccgaggtttccncatctatcgcgttcgggcccacggacgggcccagtcggacacgtcccgaagaccgtaggttccaagggtcggacgtaggggttcgggtacgtaggggaacctacggtacccttttacaaccgttctacgtaactttacctaagtttacgaccgtaaggtacggtacgggaacgtaccgtaaggtaacgttacgtttccgacgtaggttacgtttaactttacgttacgtaccgtaaggtacgttaaggttacggttaagggttaacgtttacccgttacccgttacgtttacgggttaccggtttacccgggaaccggtaaaacgggtaaaccggtaaagggttaaacggtaaacggttaacggtaaaacggtaacggtaggttaacggtaccgttacggaaccctaccgttacgttcgttaccgg

SEQ ID NO: 145740 - DNA, 725 bp, Homo sapiens
  misc_feature: GYAE6OF01CVHS7.21.4.A04.1.454.CMB.1.raw
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcgtcgctcgcacgaccggtgctcgatttagagtagtgatcaggggagagctgcccagttaggacccagagggaaccatggaaaccccagcgcagcttctcttcctctgctactctggctcccaggctcagaaaccacggagtaaattgtgttgacgcagtctccaggcaccctgtcttgctcgaggggaaancncctaccgtctcctgcacgcctccacgccagaactacnccaagactacttacacatacgcctcggtaccagacagaacgccgtacggaccaggtccctaccgtaggttcccatactcgtatcgccgttaccggtacccaggacgggcctacgtcggacctacgtaccccgaagtaccgtacggttcgaggtcggacgtaggtcgggtcgagggactacgtacgttacacgtctactactcgtagtacgcgtaacgtacggtacggaacgtcgtaagtaaacgttcgtttacgacgttacggttacgttaacgtttacgtcggtacgtaacggtacgttaacggttaagttaacgggttaacgttacccgttaccgtttaccgttacgggttacccgttaaccgggtaaacccgtaacggggttaaaccgtaaacgggttaaacgtaaaacgtaacgggtaaaccggtaaacgttcgggtaacgtaaccggttacgaacgtaacccgttacgttcgttacgttacccg

SEQ ID NO: 145741 - DNA, 807 bp, Homo sapiens
  misc_feature: GYAE6OF01A4RLC.21.4.A04.1.454.CMB.1.raw
tcagtcgtcgctcgcacgaccggtgctcgatttagagtagtgatcaggggagctctgagagcggagccccagccccagaattcccaggtgtttcatttggtgatcagcactgacacagaggactcaccatggagtttggctgagcttggtttcctgttgttatttacaggtgtccagtgtgagtgcagctggtgagtcgtgggggatacgttggtccgagtccgtgggacgggtccctaggacgtacctcgtccgtggtacgccgtacggtcccttcgtcggtacctacgtttaccgtaccgtttacgtaacggttacgaacccgtaaccgaaaccgtacggttccggggtaaccgtccggggttacccgacccgtaacggggtcccgttaccgggaacgggggtaacggggtcctaagggggtaacggttcgggggtaccggtaccgttaacggttaaccggaaacgggtaaacgttccgttaaacgtaacggttaccgaaaggtaaccgtaaggtaaccgttacgggacgtccggttactagggtaacgaaacgggttaccgttccgaacccgttagtaccgtaacgaaaggtacgtaacgttcgaacgtttaacgaaacggtacctcggtaacttacggttaacttacggtaaccgtaaacgtaacggttacggaaccgttagtaacccccgttaagggaaaacccgtcgggactaaccggtaggttactaaacgtttcgttaggaacggttacaaacgtaaggtcgttaggacgttcgggtaggtacggactaggttcgaacg

SEQ ID NO: 145742 - DNA, 813 bp, Homo sapiens
  misc_feature: GYAE6OF01EQSS3.21.4.A04.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacgganaaattgtgttgacgcagtctccaggcacctgtctttgtctacgaggggaacncgcctaccctctcctcgcacgcctccacgaccaagtaactactccaaggacgtactactacagtacgccgtacggtaccagcaagacgcctcggccacggcctccgtaggtttcccactactcgtacgtcggccgttccgggtacccacggaccgggtcctacggttcggacctaccgtacccgaacgtacgtacggttccgaggtcggtcgtacgggtcgggtcgtacgggactacgtaccgttcacgttacgtactacgttacgtaacgttacgacgtacggtacgttacgggaacctaccggttaaggtaacgtttaccgtttccgggaaacgttacggttttaacgttacgtttaacgtacggttaacgacggttaacgttaacgggttaacggttaccgggtttaaccgttttccgtaacccggttttacggtttacccgggtttacggggttaaaccccggtaaaccgggtaaaccggggttaaaccggttaaacggggtaaaccgtaaaacgggtttaacggtaaaaccggttaccggggttaggttaacccggttaacgttaaccggttaccgttttaaccggtttaccgtttctttaacccggg

SEQ ID NO: 145743 - DNA, 784 bp, Homo sapiens
  misc_feature: GYAE6OF01EFAY7.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctacacgaaaccacggagaaattgtgttgacgcagtctccgaggcctacctgttctttgtcgtacgaaggggaaagcgccctaccctctcctgcagcctccagaccaagtaactactaccagacgtaccttaactacacgttacgccgttacgggtaaccaggtaccaaggtaaccgtccgtcgggacccgtacggtccccttaccccggttaacggtttccctacgtacgttccgttaagtccggtccggttccgggtacccacggaccggacctacgtcggacaccgtccgagtaacgtacggttcgaggtcggacgtagggttcgggtacggtacgggaactacggtacctttaccgacttccgtactacgttacgtaagtacgacgtacggtacgtacggacgtacgtaaggtaacgttcgttcgaacgttacgtttacgttagttaccggtagttcaacggtacgttaaggttacgtaacgggttaacctttccgtaccgttcgttaccgggttacgggttacccgaaaccgggtaaacgggtaaaccgtttaagggtaaaacgtaaaacggttaccggaaaaacggtttacggtaggttaacccgggtaccgtaacggtaccctaagtttaccgttggtttaacccg

SEQ ID NO: 145744 - DNA, 757 bp, Homo sapiens
  misc_feature: GYAE6OF01DGNU6.21.4.A04.1.454.CMB.1.raw
  modified_base (186)..(186): a, c, t, g, unknown or other
  misc_feature (186)..(186): n is a, c, g, or t
  modified_base (341)..(341): a, c, t, g, unknown or other
  misc_feature (341)..(341): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccagtggtagtttgggctgagtcgttgggttttccttgtttgttattttacgaggtntccagtgtgaggtgcagcgtgggtggagtcggtgggggatacgttcggccaggtccggtagggaccgggttccctggaacgtccttccgtccgtgtcgacctacggtcccttctcgactacgtttcctacctttcaaggtccaaccaacaaccgnggttacggaccgttcggggcccacgtacggccgtaccgggagggggaacggggtcgtggggaacgggttcggggtaccggtaccgttaagttaaaacggaaaggtaaacgaccttaaaagtacggtttaaaccaggtaaacgaacggtaaacgtccgggcgtacggttacgtagggtaaacggaagggtaaccgttcccaacctagttcaaacgaagagtaactagtaacctaacaaacgtaccctacgtagttcgtaactcgttaagaaaccttaaagtcgaaaacccgtggaaaccctaaccgggtaaaacccggacgggtacctaaccgggtctttaaagttactttagggtagtaacggaaagaaactaagggagttgaacggttggggtacggtagtatccgttacggtac

SEQ ID NO: 145745 - DNA, 747 bp, Homo sapiens
  misc_feature: GYAE6OF01CIJKD.21.4.A04.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctacaacgaaaccaccggagaaattgtgttgacgcagtctccaggcacctgtctttgctccgaaggggaaancgccaccctntcctgccagctccagccaagaattacncagacncttaacacataacgccgtacggtaaccaggacctaaggaaacgcccgtgggacccgaacggtccctacccgtacggttccctacgtactaccgtagtccgtccggttccgggtacccaacggaccgggtaccctaaccgtgggaccctaaagtcccccgaaagggtaaccgtaacgggtttaccgaagggttacggggaaccctggggttacgggtaccgtagggggaaacctaggtaccctttacggacccgtactaaccgtatccgtaaagtttacgaacgaacgtaaccgttggaaccgtacctaaggttaacgtaactttccggtaacgtacgggttaattttaaccgtacggttagtacctaagggtactaaggtaacgttacgggtaacgttacttacccgttaacgttcgttaccgggtagacccggtaaagggaacgtaaacgtagaaacgttacgaaaccgttagtggacgtcgtacgcacgtatgttacg

SEQ ID NO: 145746 - DNA, 787 bp, Homo sapiens
  misc_feature: GYAE6OF01C4CF4.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctccaggctcacgaaaccacggagaaattgtgttgacgcagtctccgaggccaccctgttctttcgtcctaccgaaggggaaagcgacccaccctctccgtgcacgcctaccagtaccaagaactacgtaccgaagacgtcctaactaccagtacgtcccgttacggaaccacggacaaacggaacgtcccggtacggacccgaagggtccccttcccggtacggtttcccctactaacgttcgttaacgtcgtaccggtccggggtacccaacggacggggtacccctaggtcgggacccaaccgtcccgaaggtaaccgtacggttccgaagggtcggacggttaggggttaccggttcggacgggtaactacgtaccttcacctttcgtacactactagttacgacgtaggtacgtggacgtactaggtaagttacgttcgacttagtactttaacgtaccgtgttaacgcgtaacgtaggttacggttaacgggtactttacccgtaccgtttacggttcgggttaccgttacccgggtaaaacggaaaccggggttaaaccgtaaaagggttaaacgaaaacggtttaaacgggtaaaacctacgggttaggttaccgaccggttaagtaacccctaacggttaaccttaccggtttcg

SEQ ID NO: 145747 - DNA, 638 bp, Homo sapiens
  misc_feature: GYAE6OF01A7IH2.21.4.A04.1.454.CMB.1.raw
  modified_base (215)..(215): a, c, t, g, unknown or other
  misc_feature (215)..(215): n is a, c, g, or t
  modified_base (377)..(377): a, c, t, g, unknown or other
  misc_feature (377)..(377): n is a, c, g, or t
  modified_base (539)..(539): a, c, t, g, unknown or other
  misc_feature (539)..(539): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtggggganacttggtccagccgtgggagggtccctgacgacttctcctgtcgcagcctctgcctattcaccttcagtcgaccaacactagtcggacgtcgggtcccgcgaggcctccggaaggggacgggctgggaggtcggggtcggaccgttataacggaaaggtaancgtaaacgagttaccaagtacaaggatacgggcgtcgtctaggtaggaaaggtacggttaccaaccgtatctacgaaagacgtataggaacttacgaaaacgtactacgtaaccttagtactactagtacaaatacgaacgacgtacctaacggaaaaccgnggaccgacggtaccgttagttaacttacgtaggtacggtaagaaacgtaaagggtggtaaggtagttagggttagggttaggtacggtagttggaacgg

SEQ ID NO: 145748 - DNA, 613 bp, Homo sapiens
  misc_feature: GYAE6OF01BXYED.21.4.A04.1.454.CMB.1.raw
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (392)..(392): a, c, t, g, unknown or other
  misc_feature (392)..(392): n is a, c, g, or t
  modified_base (603)..(603): a, c, t, g, unknown or other
  misc_feature (603)..(603): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccaggcctgggagggtcccctggacgacctctccgtgtgccagcctctgcattccaccttcagtgaccacaacntggactgggtccnccaggctaccgaggggagggctagggagtgggtcgccgtatacgaaggaagctaacagttacaagtacagaatacggcgngtctgtaggaaaggtagttacaccatactacaagagatagattacaaagtaactacaacttgtaacttactagtacaaagtacgaaacgaacgtacccgtaacggaaaacccgacgggaaccgaaccgggtaccgttagttaacttaagtttggtacgggttaagaaacgtaaaaggaaggtagggtaacgttggtacgggtagggtacgngttggtacgg

SEQ ID NO: 145749 - DNA, 690 bp, Homo sapiens
  misc_feature: GYAE6OF01AT83W.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaancgccaccctctcctgcagcctccagccagaactatcccagacgaccttaactacactacgcccgtaggtaaccaggacaggaacgcctacgggacccaaggtccctaccccgtaggttccctaccgacttccgttactcggtcgtccgggtacccacggacgggtcccacgtcgacacgtaccagtacgtacggttcgacggtcggaccgtaggtcgggtacgacgggactacgtacttaccgactcgtacaagttaccaatttacggcaacggtacggttaggaccgtacgttaggaacgttacgttacggtaccgtagttaacgttacgtttacttacggtacgaaggttacctaggttacgttaaggggttacttccaaccgtttcgttacggttacccggttaccggaacgtaaaccgggacgtaaggtaaccgtaagaacggtaacgtacgtaaggcggtacacggtactacctgttcgttaccg

SEQ ID NO: 145750 - DNA, 1020 bp, Homo sapiens
  misc_feature: GYAE6OF01CNYG0.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcacctgtctttgctccgaggggaaagcgcccaccctctcctgcacgcctccagacccaagaatactccaaggacgcctaacctacaagttacgcccttagggtaacccaggaccaacggaaacggtccctttacggacccgacgggtccccttaccccgtaacggtttcccctactacttaccgttaacgtcgggttcccggttacccgggggttacccccgaacggtaaccggggggtacccctaacccgggtttcggggacccctaaccgttaccccccggaaaggtaaccccgttaaggggttttcccgtaagggggttccgggggaacccggttaagggggttttccggggggttaccgggttaaccgggggggtaaacccgtaacgggtttaaccccgttttaaccccgtaaccccgttttaccccttacgttaaccgtttacctttaaacggttttaaccggtaacccggtaaaccgggtaacccgggttaacgggggtaacccgggttaacccggtttaaccgggtaaaacggtttacccgtttttaaccgggttaaccggttaacgggtttaacggttttaacgtttttaaccggtttaacggttaccggtaacggtaacgtttaaacgggttaaacggtttaccggggtttaaacgtttaccccgttaacccgtttaccggttttaccgggttacccgggtttacccgggaaaccccgggtaaacggggtaaaccccggtaaaaggggttaaacggtaaacggttaaacgggtaaaccggttaaccggttacggttacgggtaccgtacggtaacccgtaccgtaacgttcgtttacg

SEQ ID NO: 145751 - DNA, 760 bp, Homo sapiens
  misc_feature: GYAE6OF01COUGL.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctggagtcgttgggtttttccttgtttgttattttacaaggtgtccagtgtgaggtgcagctgggtggaggtcggtgggggagtacgttcgggtccacggtcccgtagggacgggtccctggacgtacctcctcctggtcgccgacgtccctctcgactacttacctaccctttcgaacgtccgaacccaacaaaccagttacgggaccgtcggggtcccgccgaacggtcccgtaccggaaggggaacggggtcgtaggggacgggtcggggtccggtaccggttaattaaccggaaacggaaacgtaccttaaacgtaaggttaaccaaggtaacaacggtaaacgtccgggacggtccggttacgtagggtaaggtaaacggggtacgtttcccaacctagttacccagaaaggtatagtagtaacttaacgaaaagtacctacgacttgtactacgtacgaactaacgtacgtaacacgtccgtaaaggaaacccggtacggacgtaaccggttcgttaagttaagtttcgtaagggtacgggtaaaggaaaactaaaggggttcggtaagggtacgttgggggttaggttacgggtaacgtggttaggtaacg

SEQ ID NO: 145752 - DNA, 686 bp, Homo sapiens
  misc_feature: GYAE6OF01ECIL8.21.4.A04.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaagacgccaccctctcctgcagcctccacgccaagaatanccgagagctactacactacgccgtacgtaccacgacaaggaacgcctacggccacggccctccccgtacggtttccctactacttctagtcggtccggttcgggtacccacgacgggccacgtcgacctactcccgaagacgtacggttcgaggtcggtacgtagggtcgggttcgtacgggaactacggtaccctttcgtaacccttctactacttcgtaacgttacggacgtacggtacggttacgggacgtaccgtagtaacgttacgtttacgacgttagttagttacttagtcgtacagtcgtaaggttagtacgttaacttccgtacgttcgttcggttaccggtaccggaaccggtaaccgggaaccgtaaagggttaaacgtaacgtaacggtaaacgtacggttagtacggtactacgactaccgtagttcgttaccg

SEQ ID NO: 145753 - DNA, 737 bp, Homo sapiens
  misc_feature: GYAE6OF01CYA1F.21.4.A04.1.454.CMB.1.raw
tcagtcgtcgctcgcacgaccggtgctcgatttagagtagtgatcaggggagagctgctcagttaggacccagagggaaccatggaaacccagcgcagcttctcttcctcctgctactctggcctccagctcagaaccaccggagtaaattgtgttagacgcagtcctccgaggccaccctgttctttgtcctaccgaaggggaaacgcgacccaccctcgtcctgccacgcctccagaccaagtaatactaccgaagacgtcctaactaactagtacgaccgttacggtaacccaggaccaaaggaaccgtcccgtacggggacccgacgggtacccttaccccggtacggtttccctacgtaaccttcttacgtcggtacccggtccgggtaaccccaggaccgggtcctacggtacgccaaccgtacccgagtaaccgtggttacgaggtcgacgtagggtcgggtcaggtaacctggtacccttacgactccgtactagtaactagttacgaacgtacggacgtacgtacgaccgttaggtaaagtttcgttacgtacgttaacgtcgtttacctttacggacggtttacaagggttaaccgtaaggttacggttaacggtactttacccgtaccgtttcggtacggttaccgggtaccgaaccgggtaacggtaacggtaaggtaaagacgttaaccgaaagtcgtcgagtcacgtacacgttcgtcgtacg

SEQ ID NO: 145754 - DNA, 716 bp, Homo sapiens
  misc_feature: GYAE6OF01DIZLL.21.4.A04.1.454.CMB.1.raw
  modified_base (205)..(205): a, c, t, g, unknown or other
  misc_feature (205)..(205): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcaggggagcctctgagagcggagccccagccccagaagttcccaggtgttttcatttggtgatcagcactgaacacagacggactcaccagtggagtttgggctgagcgttggttttccttgttgttatttacaaggtgtccagtgtgaggtgcagctggngtagtcgtggggagtacgttggccagccgtggacggtcccngacgacctcgtcctgtcgctagccctcgtacgtctagttcctaccgttcgagtccgaaccaacaacgtagtcggaacgttcgggcccgacgacggccgtacggaaggggtacgggcgttgggagggttcgggtaccggtacgttaagtaacggaacggaaactacgtaaacgtacgttaacgaagtaaccgaaggtaacgtccgggtaccgcggttacgtaggtaacggaaagggtacggttacaacgtactagaacgaagtacggatacgtaagtaacaaacgtaacctacgtaacttacggtaactacgtacggtaaaccctaaagaccgtaaacgacggtaaccgtaaaccggaaaaccggcgggaaaccgtccggtaaccgttaggttaaaccttaggtaagggtacgttaaagaacggtaaaggtacggtaggtacggttggtagggaggttcgtgagttaccgg

SEQ ID NO: 145755 - DNA, 642 bp, Homo sapiens
  misc_feature: GYAE6OF01EFHJD.21.4.A04.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaancgccacctctcctgcagcctccagccagaatactccagacnctactacatacgcctggtaccagcagacgcctggccaggcctcccgaggtttccnatctatcggccgtcgggtcccacgcgggcctacgtggaccactcccgagaccgtaggtcaggtcggcgtaggttcgggtcgtaggactacgtctttacaccgttctactatctaagttagacgacgtacgtcggacgtcgttaggtaagttacgtttcgacgttacgttatttaacgtttactacgttacgagtacgttaaggttacgtacgggtaactttccgaaccttcgttacggttccggttaccggaccggaaacggtaaccgtaaagggtaacgtaaaggttaacggaaacgtacggtcggttacgtacgttacggaacctacgtacgttcgtttaacg

SEQ ID NO: 145756 - DNA, 822 bp, Homo sapiens
  misc_feature: GYAE6OF01DO8YW.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaggtgtcagtgtgaggtgcagctggtggagtcgtgggggatacttggtccagccgtgggagggtccctggagactctcctgtcgacacgcctctgctacttcacccttcagtcgaaccacaacagtcggacgtcgggtcccgccgacggcctaccggaggggaacggggcgttagggaggttcgggtacggtccgttaagtaacgaaaggaaacgactaaacctaagttaaccaagtaacaagtaaacgtccgggacgtcggtacgtaggtaacggtaaacgggtaacgggtttacccaaccgtaacgttaccctaacggaaaaggtaaggtaacttaaggtaacctttaaccggtaaaaacgtaaacccttaccgtaaaccgttaggttaaactaccttaacgaaacctaaaacggttaacggaaaacccgtaaccgggtaaccccggttaaacgggaaaaaacccccggtaggggtaaccggtaaaccccggggttaccccggtttaaggtttaaaccgttttaaggtttaacgggttaacgggggtttaaaagaaaaccgggtaaaaagggttacggggttaaggtaaagggtttcggggtttaggggttaaccgggtttaggtcccggtttagggtaaacccgg

SEQ ID NO: 145757 - DNA, 664 bp, Homo sapiens
  misc_feature: GYAE6OF01CPW0T.21.4.A04.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (468)..(468): a, c, t, g, unknown or other
  misc_feature (468)..(468): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctcggcctcccaggctacaacgaaacccaccggaagtaaattgtgttgacgcagtctcagcaccctgttcttcgtctaccgaggggaanctccacctcgtctgcacnctcagccaagatacncaganctaacacatacgcgtacgtacagacagaacgccgtacgccgacggtcctacccgtacggttaccctctaacttaccgtagtccggtccgttaccgggaccccaacggaccgggtcccaggttccggacactacccgagaccgttaaggttccgagggttcggacgtaacggggttcgggtaccggtaagggactaacgtacgtttaccgaacgttccttanaactacgtacgttacgacgtaacgagtacgacgtacgtaagtaacttgtcgtagtagtacgttattacgttcacgtagacgttagtagtacgtacgttaaccgtcttagtacggttcggtacggaccgtaaggtaacgtaaggaaacttaagggactaaacggtgtcgtacgtgtaaccgacaacgtgttcgttcg

SEQ ID NO: 145758 - DNA, 813 bp, Homo sapiens
  misc_feature: GYAE6OF01B9QI0.21.4.A04.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccacggagaattgtgtgacgcagtctcagcacctgtctttgctcgaggggaaancgccaccgtctccgtgcacgtcctccagccaagaactactaccgagacgtctaacgtactagtacgtccgtacggtaaccagacgaaggaaccggtccgtacgggacccgtacgggtcccttaccccggtaacggtttccctactaacgtttccgtacgttccggtacccggttccgggtaccccgaacggtaccggggtccctaaccggttcggaacctaccgtaacccgaaggtaaccgtggttacgaggttcggaccgttagggttcgggtacgtacggggtaacctacggtaccttaccgtaccgttcctacgtaagttaccgttaagttaacggacgtaacggtaacgtgggtaaccgttaccgtaaggtaacggtttccgtttacgacggttaacggttttacgtttaacgttacggtacgttacgtacgtacgttaaaggttacggttacgttaacgttccgttacccgttcggtttaccggttaccgggttacccgggaaccgtaaacggggtaaacggtaaacgggttaaacgtaaacgttaaacggtaaaacgttacggttacggttaaccggtaccgttacggacccttaaccgttcgttccgtttacccg

SEQ ID NO: 145759 - DNA, 679 bp, Homo sapiens
  misc_feature: GYAE6OF01B1NKS.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgctccgaggggaaancgccaccctctcctgcagcctccagccaagaatactccagacgcctactacatacgcctggtaaccagccaagaacgcccgtcggaccagggtcctccccgtaggttccctctacttctagtcgccgttcgggtccccagacgggtcccagtcggcacgtcccagacgagttcagtcggcaggtcggtacgtagggactacggtactttccgaacttcgtactacgttacgtaacgtttacgactaacggtaacgttcggggaaacgtaccggtaagtaacggttacgtttaccggtacttaaccggtttagttaacgttttacgtcgttaactacggacttaacggtacgttacgggtaaccgttccgttaaccgttcgttaccggtccgttaccgggaccgtaaaccgggtaaccgtaaggtaaacgtaagtaacggtaaacgtactggtacgtcgtacgacacctgttcgttacg

SEQ ID NO: 145760 - DNA, 761 bp, Homo sapiens
  misc_feature: GYAE6OF01D4E06.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcaccctgttctttgtctccgaaggggaaancgcccaccctctcctgcagcctccacgccaagaactactccagacgctactacagtacgcctaggtaccagcaagaacgcctggaccaggcctacccgtaggtttcccatacttcgtatcggcgttccgggtacccacggacgggcccacgtcggacctaacgtcccgaaggaccgtacggttaccgaggtcggacgtaggggttcgggtacgtcggggaactacgggtcctttaccgacgttcctacgtactacgtaagttacgacgtaacggtacgttacgggaacgtaccggttaggtaaacggttacgtttaccgggtacgttacggtttacgtttaactttaccggttagttaccgtaagggtaccgttaagggtttacggttaacggggttaacctttacccggttaacccgtttcggttaccggttaccgggttaccgggtaacccgggtaaacggggtaaaccgtaaagggttaaacggtaaaacgtacgggtaaaacggtacgttacgggtacggtaccgtacgtaaccctaaccgtgttccgttaccg

SEQ ID NO: 145761 - DNA, 709 bp, Homo sapiens
  misc_feature: GYAE6OF01A4S9F.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagcctccagccaagaatactccagagctactacatagcctggtaccagcagaacgcctcggccaggcctccgagttcctcatctatcgcgtcgggtcccacgacgggccacgtcggcctaacgtaccccaagtaccgaggtttaccagggtcgacgtagggtcgggtactgggaactacggtacctttcgaaccttcgtactacgttactaacgtttacggcctaacggtaacgttacgggaaccgtacgttaacggtaaacgttaccgttttacggaccttagggtttacgttaactttacgttacggtaccgtaagttaccgtaaggttacgtaacgggttaaacgtttccgtaaccgtttccgttacgggttccggtttaacccgggaaccggtaaaaccggggttaaccgtaaaagggtacggtaaaagtacggtaaaaccgtacggttggtacggtaccgtcgaacctaccgttacgttcgttacg

SEQ ID NO: 145762 - DNA, 776 bp, Homo sapiens
  misc_feature: GYAE6OF01A6E2R.21.4.A04.1.454.CMB.1.raw
  modified_base (216)..(216): a, c, t, g, unknown or other
  misc_feature (216)..(216): n is a, c, g, or t
  modified_base (383)..(383): a, c, t, g, unknown or other
  misc_feature (383)..(383): n is a, c, g, or t
  modified_base (492)..(492): a, c, t, g, unknown or other
  misc_feature (492)..(492): n is a, c, g, or t
tcagtcgtcgctcgcacgaccggtgctcgatttagagtagtgatcagggagagctgctcagttaggacccagagggaccatacggaaccccagcgcagtcttctcttcctcctgctactcgtcggctcccaggctcaacgaaaccgaccggagtaattgtgttagacgcagtctaccgaggccacccgttgttctttgaccgtacgaaggggaaancctccctaccctctaccgtcgacacgtcccaccgagaccgaagtaactacgcccgaacggtacgtacttaacccgtaaagaccgtacgtcccggttaacgggtaacccagaccgaaacggacgtcccggttggaccccgaggttccctaacccggttgtaccccttnagtttacctagtccggtccggtaaccccgggtccaacggacgggttaccctacggtccgacttaacccgcccggtaaacgtccgggtaacggtttacgcggttacgggngtaccggggttggtaccggacggttaacaacggttccctttcgagtcccttaggtaccctacgtacgtactacgacgtacgtacggtacgtacgtacgtacgtacgttacgttacggtacgttcgttaacgtacgttacgtacgtacgtacgttaacggtcgttaacggttaccgttacctcggttacgttaccggtccggtacggtaccggacggtaacgtaaggtacgtaacgtaacggtaactacggtacgcgttacgacgtaccgtacgttctcggttac

SEQ ID NO: 145763 - DNA, 767 bp, Homo sapiens
  misc_feature: GYAE6OF01DCP8R.21.4.A04.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagcttgggttttcctgttgttattttacaaggtgtccagtgtgaggtgcagctggtggagtcgtgggggatacttggtccagccgtgggacggtccctgacgactctccgtgtgcagcctctgcattccaccttcagtcgaccaacaacgataggacgtcgggtcccnccgaaggcctaccggaaggggaacggggccgtagggagggtcgggtaccgggtacccgttaaagttaaccgaaaagggaaaacgtccttaaaaaccgtaggttaaactacggtaaaccgaaggtaaacgttaaccgggccgtcggtacgttagggtaagggtaaaacggggtaacggttacccaaccgtaacgttaccgtaaccgtaaaggtaagtaacgtagtaaacgtttaaccaaaaacggtaactaccgtaaacgttacggttaacttaccgttaagaacccgtaaaagttaaccgaaaacgtaccggtaaacccgttaaacggaaaaacccgggtagggaaacccgtaaccgggtaccgttaagtaacgtttaagttaggtaagggttaaacgaaacgtaaaaggtcgggtaaggtagtagggttacggtaggtactggtaggtaaccgg

SEQ ID NO: 145764 - DNA, 705 bp, Homo sapiens
  misc_feature: GYAE6OF01A0OFT.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgttctttgtctccgaggggaaancgcccaccctctcctgctacgcctccagccaagaatactccagacgactactacatacgccgtaggtaaccagaccaagaacgcctacgggccaacggccctacccgtaaggtttccctacattctatcggtccgtcgggtacccacgacgggccaacttcggacctacgtcccgatacggtacgttcgaggtcggcgtagggtcgggtccgagggtacctacggtacctttaccgaccttccgtacgacttacgtaagttacgacgaacgtacgtcgggaacgtaccgtaaggtaacgtacgtttaccgacgttagtttacgttaattacgttcggtaccacgttaacgtaaggttacggtagggttaacttaccgtaccgtttgttaccggttacggttaccgggaaccggtaaacggggaaaccttaaaggggttaaacgaaagtaacggtaaacgtaacggtggtaaccgcgttagacccttaccgtagttcgttaccg

SEQ ID NO: 145765 - DNA, 659 bp, Homo sapiens
  misc_feature: GYAE6OF01D62MA.21.4.A04.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaancgcccaccctctcctgcagcctccagccagaactactccagacgctactacatacgcctaggtaccagacagacgcctggccacggtcctacccgtaggtttcccncacttcgtatcggccgttcgggtacccacggacgggtcccacgtcggaccacgtcccagtacgtcggttcaggtggcgtagggtcgggtcgagggaactacggtacctttcgaaccttctacgatctaagtttacgcgtaagtacgtaggacgtaccgtagtaacggttactttaccgacgtagtttacgttactttacgtcgtacgagtacgtaagttagtacggttacttaccgtaccgttcgtcggttaccggtaccggaaccggtaaacgggtaaccgtaaagggtaaacgtaaaggtaaccggaaacgtacggtcgtacggtctacgtaactacctgttccgttacg

SEQ ID NO: 145766 - DNA, 786 bp, Homo sapiens
  misc_feature: GYAE6OF01EM5O4.21.4.A04.1.454.CMB.1.raw
  modified_base (93)..(93): a, c, t, g, unknown or other
  misc_feature (93)..(93): n is a, c, g, or t
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
tcagtcgtcgctcgcacgaccggtgctcgatttagagtagtgatcaggggagagctgctcagttaggacccagagggaaccatggaaaccccngcgcagcttctcttcctctgctactctggctcccaggctcagaaaccaccggagaaattgtgttgacgcagtctccaggcaccctgtctttgtctcgaggggaaantccacctctcctgcagctccagccagtaatatccaganctactacagtacncctggtaccagacaagaacgccnggccacggctcccgacgtttccncatcttatcggccgtcgggtacccagacggggacccagttcgggaccactacccaacggacgttacggttacaaggttcgggcgaaggttcgggttactaggggactacgaacctttcgaaccttcncttaactacctaagtttaaacgccgaaggtaccgttagggtaacgacccggttaggtaaacgtacgttttaaccgggacttagggtttaaggtttaactttaacggttttcgaaccgttagggactaaaccggttaacggtttaggggtttaaaaccgtttcttaacccgtttaccggttcggttttaaccccgggtttacgggaaacccccgggttaaaaggggtaaaaccccgggtaaaagggtttaaaacgggttaaaaacctttaaacgggaaaaaaaccgggttaacctttaagggggttaaccggtaccgtttaacgggaaccccgtaaacccttaccgttaacgtttttacccggg

SEQ ID NO: 145767 - DNA, 914 bp, Homo sapiens
  misc_feature: GYAE6OF01BH1I8.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctacagaaccaccggataattgtgttgacgcagtcctacgaggcctaccctgttctttcgcctacgaaggggaacgcgccctacccttcctccgtgccgacgtcctaccacgaccaagtaactaccgtaccgaggacgtaccttacgtaacagtacgtacccgtacggtaacccaggtaccaaggaaccgtcccggtacggcccgacggtaccccgttccccgtaccgggtttccctaccgttaacttcgttaacggttcccgttaccgggttaccggggttaccccccagggtaccccggggtcccgtaacggttccggtaacccgtaccctaacccggaacgtaaccccgggtttaaggttaccggtacgggttacggggtaccggttacggggtttaccgggggttacggttacggggacccttaaccggggttaccttttacccgacccggtttaacgtccgttaacgtttaccttacgggtttaaacccgacggtaacgttacggttaccgggaacgtttaccggttaacgggtaaacctttacggttttaccggaggttaacgtttagtttacgttacgggtttaactacgggtaacgttacggttaacgttagttacgggttaacctttaccccggttacgtaccggtttacgttaccccggggtacggaaaccggtaaccggggtaaacggttaacggtaaacggtaagtaaaccggaaagttacccggtaaggtacgttacgaccggttaaacctccgttacgtcggttacccg

SEQ ID NO: 145768 - DNA, 825 bp, Homo sapiens
  misc_feature: GYAE6OF01AUORK.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccagtggtaggtttgggctgagtcgttgggttttccttgtttagtttattttacgaaggttcgtccgaggtgtggagggtgcgaggtcgtgggtggaggtcgggtagggggagtaccgttcgggtaccgacggtccggtaggggaccgggtccctaggacgtacctccgtccgtggtcgctacgtccctcgtcgactacttcccaaccgttcgaacggtaccgaacccaactaaccgtaggttacgggtaccggttccgggtcccgaccgacgggtacccgtacgggacgggggacgggtacggtcggggacgggtcggggtccgggtacgtaacggtaacggaaaggaacgtactaacggtaagtaacgaacggttaacaaggtaacgtacgggtccgtacggttacgtaagggtaaacggaaacgggttcgttaaccgaacgttactacgtaagaaacggtagtagtaacgttaaactaaccggaaaacttaaccgtctacgttaagtacttacggtaacaaacgtaagaaccgtaaaccgtaacggtaacccgttaaaacggaaacccggtacggtaacccggaccggttaccgttaaggtttaacgttacgggtaaggttaacgggtaaaacgaaaggtaaagggtacggttaagggagttacggggttaggtacgtcggttcgtaggtaacg

SEQ ID NO: 145769 - DNA, 722 bp, Homo sapiens
  misc_feature: GYAE6OF01CLLQX.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggcctcccaggctcaacgaaaccaccggaataaattgtgttgacgcagtctccaggcacctgttcttgtctaccgagggaaancgccaccctctcctgcagcctaccagcctaagaatactccgaagactactaactacatacgccgttacggaaccaggacaaggaaccgcctacgggaccgaggtcccctccgtaacggtttccctacgtacttacttacggtcgtccggtttccggggtacccctaacggaccgggacctacggttcgggacctaccgtacccgaagtaccgtagggttccaagggtcggacgtagggtttcgggtcgagggaacctaaggtacctacgtacctactcgtaacttacgtaagttaaccgcgtaacggtacgtcgggaaccgttactaaggtaaacgttacgtttcccggaagtacggtttaactttaacgttcgtacgttacagtaaccgtaaggttacgttacggtaacttccgtacgtttcgtccggtacgttacccggaacgtaaacgggaccgtaaaggtaacgaaagtaaccggaaacggtacgtggtaacgccttagacccactgttcgtacg

SEQ ID NO: 145770 - DNA, 712 bp, Homo sapiens
  misc_feature: GYAE6OF01EQ1WB.21.4.A04.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggccacccttgtctttgctccgaggggaaangcccacctctccngcagctaccagaccaagaatatcccagagacctatacatagcctcgtaccagcaagaacgcctacggaccaggcctccctaaggttccctactatcttagtcgccgtaccgggtacccaggacggccacgtcggaccaacgtcccgacgtaacgtacggtttccaagggttcggacgtaggttggggtaccctaggggaacctacggtacctttacgtaccttacctacgtattaccgagttaccgtaacgagtaccgaggtacgtaccgtaagaagtaacgtttcgaacgtaggtttacgttaacttacgttacggttacgaacgtacgtaacggttagtaacgggttaacgtttacctaaccctttggacggtttaccggtaccgggtaaccgaaaacgggtaacccgtaaaagggtaaggtaaaactaacgggtaaaaccggaacgttacgggacgggtaacgtacgaacccgtaaccctagttccgttaaccg

SEQ ID NO: 145771 - DNA, 907 bp, Homo sapiens
  misc_feature: GYAE6OF01DFUZ4.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaccaccggagaaattgtgttgacgcagtcctccaggccaccctgttctttgtctccgaagggaaagcgccaccctcncctgcagcctccagaccaagtaatactaccgaagacgtacctaactacacgtacggtacccgttacgggtaacccacggactaacggaaaccgtcccgtacggacccgaacgggtcccttaccccggttaccggtttcccttaccgtaacttccgttaacgtcggtcccggtttaccgggtacccccggaacggacccgggggtacccctaaccggttaccgggacccaccttaccccgaaacgggtaaccgttacgggtttaccgacgggttcgggaccgggtacgggtttacgggggttccggtaacgggggaccctaacgggttaccctttaccgtaaccgtttccttaacgtaccgtttacgttaaccgtttaacgggaacctaacggttaaccggtacgggtaaccggtaccgttaaacgggttaacgttacgggtttacgtaaccgttaggtttacgtttaactttacggtcgtttagaacgtacggttaacgttaacggttacgggttaaaccgttttcctaaccgtttcggtttaccggtttaccgggtacccccggggttaaacgggaaaccggggttaacgtaaacggggtaaacgtaaaacgggttaaacgtaaaaccgggttacgttacgggtaacggttccctaacggtacccgtacttaacgtttccggtttaaccg

SEQ ID NO: 145772 - DNA, 720 bp, Homo sapiens
  misc_feature: GYAE6OF01EME0K.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgcctactctggctcccaggctcagaaaccaccggagaaattgtgttgacgcagtctccaggctaccctgtctttgtctcgaggggaaancgccaccctctcctgccagcctccagccaagaatactccagacgctactacatacgccttgggtaccagcagaacgcctggccaggcctaccccgaggtttcccacgactctagtcggccgttcgggtcccacggtcgggacctacgtggcctacgtccccaaggtaccgtaggttccgaggtcgggcaggggttcgggtcgtaggggactacggtacctttcgaccgttgtacctagttctaacgttaacgaccgtaggtaccgttacggacgttaccgtaaggtaaacgttacgttttacggacgtaaggtttacggtttaacctttacgttacggtacgaacgtacggtaacgttaaggttacggggtaactttccgtaccgtttcgttacggttccggttaccgggtaccgtaaacgggtaacccgtaaagggttaccgaaaggtttaaacggaaacccgtacggttacggtaacggtacgttaccggaaccgttacctaccgtttcgttaccg

SEQ ID NO: 145773 - DNA, 815 bp, Homo sapiens
  misc_feature: GYAE6OF01CC2JI.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccacggagaaattgtgttgacgcagtctccaggcaccctgttctttgctccgaggggaaacncgccacctctcctgcagctccagccagactatccagagctactacatacgcctaggtaccagtacaagaacgccgtaggaccaggccttccccgtaaggttccctacgacttcttatcgaccggttccgggtcccaacggtacggggccctaacgtcggtaccacgttaccccgaaggaaccgtacggtttacgaagggttcgggacgtaacgggttcggggtaccgtaacgggggtaccaacggtacccttttaccggtaacctttcccgttaactataccgttaacgtttaacggtaccgtaacggtaccggttacgggttaacgtacccgtttaagggtaaacggtttacgtttacgtaccggtttaagttaccggttaacgttttacgttcggttactaacggtcgttaaacggttacggttaacgggttaacgtttaccgttaaccgtttcgggtttacggtttaccgggttacccgggaacccggtaaaacggggtaaacccggtaaacgggtttaaaacggtaaagtttaaacccgggaaaacgggttaaccgttaagggtacggttacctacggaacccgttaaccgttaagttacccgtttacg

SEQ ID NO: 145774 - DNA, 927 bp, Homo sapiens
  misc_feature: GYAE6OF01DS62H.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagaaattgtgttgacgcagtctccaggcaccctgtctttgtctcgaggggaacncgccaccctctcctgcagcctccacgaccaagaactactccagacgctactacatacgccgtggtaccagcgagaacgtccgtggccacggtcctaccccgacggtttccctctactcgtagtcggtccgtccgggtacccaacggtacggggaccctacggtgggtacccaaccgttaccccgaaggaccgttacggtttaccgagggttacgggacgtacggggtttcggggtactacgggggaacctacgggtacctttaccggtaacctttcgtacctacgttacttaacgttacgaccgtaaggtaacgttcgggaacgtacccgttaagggtaacgtttacgttttaccggaacgtttaagggtttacgttaaacgttttaccggtacggttaaccgtacggtttaaccggttaaacggtttaacggttttaaacgggggttaacccgtttttaacccccggtaaccccggttttttaccgggttttaccggggtttaaccccgggtttaccccccgggggtaaaacccgggggttaaaaaccggggggttaaaccccggtttaaaaaggggggttaaaaaaccgggtaaaaacccgggtttaaacgggggtaaaaaaacccccggtttaacgggtttcgggggtaaaacccgggttacccgttaacccggttaacccgtttaaaccccgtttaaacggttttccccggtttaaaccggg

SEQ ID NO: 145775 - DNA, 989 bp, Homo sapiens
  misc_feature: GYAE6OF01ASIWH.21.4.A04.1.454.CMB.1.raw
tcagtcgtcgctcgcacgaccggtgctcgatttagagtagtgatcagggggagctctgagagcggagccccagccccagaattcccagggttgttttcatttggtgatcagcactgaacacaggaggactcaccagtgggagtttgggctgagtcgttgggttttccttgtttagttattttacgaaggttgtccagtgtgaggtgcagcgtgggtggagtcggtaggggggatacgttggtccacggtccggtgggacgggtccctggacgtaccttccgtccgtgtcgcgacgtccctcgtacgtcctacttcctacccgtttacgaacgtaccggaacccaactaactacggtagggtaccgtcgggtcccgaccgacggggtcccgtacggggtaacggggggaacggggtcggtaggggtacggggttacgggggtaccggttaaccgggttaacgtttaaaccggaaagggtaaaacggtaccgttaaaacgtaacggtttaacggtaaacggttaaacgtaacgggtaaaacgtaaccggggtccggttaacggttacggttaagggttaaaccggggtaaaacggggggttaacggttaaccctaaacgttacgtacccgtaaagggtaaaaggtacgttaggttaacgggttaaatttaaccccggaaaaagttaaccctttacccgggaacttttacgggtaactttaacccggtaaggaacttaaaaaccggtaggtaaaaccccgtaaccgggttaaacccgaaaaccggggaaaaaccccgggtacgggtaaacccgggtaaccccgggtttcggttaaaccggttttaaaggtttaacgggtttacggggtaacggggttttaaaaacggaaacggggtttaaaacgggaacgggggtttaagggttaacgggttttacgggggttagggggtttacccgggggaatttaacccgggggtactttaaaccggggg

SEQ ID NO: 145776 - DNA, 756 bp, Homo sapiens
  misc_feature: GYAE6OF01EB1DW.21.4.A04.1.454.CMB.1.raw
  modified_base (334)..(334): a, c, t, g, unknown or other
  misc_feature (334)..(334): n is a, c, g, or t
  modified_base (503)..(503): a, c, t, g, unknown or other
  misc_feature (503)..(503): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctgagtcgttgggttttcctgttgttattttacaggtgtccagtgtgaggtgcagcgtggtggagtcggtggggatacgttggtccagtccgtggacgggtccctaggacgtaccttctccgttagcgacctacgtcccttctcggtaccttaacttaccctaacccttcgaacggttcaaaacccctaanaaaccgtaggtacgggtaccggtcgggtacccgacccgtagggtacccgacgggtaaacgggggtagggtccgtagggtacggggttcgggtaccggtaccgtaaagtaaacggaaacggaactacgtaaacgtacgttaacgacggtaaacacggtaagtacccgggntacggtacgtaaggtaagggaaacgtaacggttaccaacgtacgtacgtaacgaagtagtaactagtaactaacaaagtactacagttacgtatacgtagaacaaagtaccaaacgcgtaacctaaacgggaaaaccggacggtaaccgtaccggttaacggtagtttaacgttaggttaacggtaagtaaacggaaacgtaaaagggacgttagggtaagttgggtaggttaacggtacgtcgtaggtaacg

SEQ ID NO: 145777 - DNA, 747 bp, Homo sapiens
  misc_feature: GYAE6OF01EXDAG.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccacggagtaattgtgtgacgcagtctcgagccacctgtcttgtctacgaagggaancgccctacctctcctgcgtacgcctaccgacgaccaagtaactactaccgaagacgtactaactaacacgtacggtccgtacggtaaccagacgaaggtaaccgtccgtacggaccgacggtccctacccgtacggtttccctacgtacttacgtacgtcggtaccggttaccggtacccgacggtacgggccctacggtcgacctaccgtacccgacggtacgtacggtacgacggtcggacgtagggttcggtacgtacggaacgtacgtcttacacgtctactactactacgttaacgactacgtacgtggacctacgtagtaacgttcttacggattacgttagttacgtacgtcgtaagtagtaacgtaaggttacgtacggttaaccgttccttacggtaccgtttcggttaacccgggtaacggaaacccggtaaaggggtaaacccggttaaaagggtaaccggtaaaatacggggttaaaacccttacgggttgggaacccggttacttaaccggtaaccgttaacgttccgttgttaacccg

SEQ ID NO: 145778 - DNA, 643 bp, Homo sapiens
  misc_feature: GYAE6OF01CNHR1.21.4.A04.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgttcttgtctccgaggggaaancgccaccctctcctgccagcctccagccaagaactactccgagtacgcctaactacagtagccttaggtaaccagcaagaacgcctggccaggcctcccgtaggttccctanattcctagtcggccgtccgggtaccccaggacgggtcccaacgtcggacactccgagactggtcnggtcgcgtaggtggtctaggacncgtacttcgactctnactctagtagcgtagacgtggacgacctaggtaacttcgtttacgacgtaggttcttaacgtttaccgtagtactaagtccgttaagttacgtacgggttacgtttaccttacccgtttgtcggtttaccggttccgggaaacgtaaccggggtaaccgaaagggttaacgtaaagtacggtaaaacgtacggtacggtaggtcctacggactaccctgttcgtacg

SEQ ID NO: 145779 - DNA, 840 bp, Homo sapiens
  misc_feature: GYAE6OF01DPI7L.21.4.A04.1.454.CMB.1.raw
  modified_base (193)..(193): a, c, t, g, unknown or other
  misc_feature (193)..(193): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaccaccggagaattgtgttgacgcagtctcagccacctgtcttgctcgagggaancgccacctctcctgcagcctaccagccaagaactactaccgagacgtcctaactacatacggtcccttaggaaccaggaccgaaggtaaccgtccgtacggaccctacgggtccctaccccggtacggtttccctacgtacttaccgtaacgtcggcccggttaccggggacccccaagggaccggggtacccctaacggttcgggacctaaccgttacccgaaaggtaaccgttacgggtttacgacgggttacgggcgttaacggggtttcgggttaccggtaacgggggtaacctacggttaacctttccgtaaccttccgttaacgtacgttacgttaaacgtttaacggaacccgtaacggttacccggttacgggaccgttaacccggttaaggaaaccgttttaacgttccgggtaacgtttaaggtttaccgtttaacgttaccgtttaggtaccgtaacggttaccgtaaggtttacgttaacgggttaacccgtttaccgtacccgtttcggttaccgggttaccggtaccgggtaaaccgggtaacgggtaaaccgtaaaggggtaaactaaagggtaacggtaaaacgacgttcggaacgttcgttacggacccttaacgttagttcgttaccgg

SEQ ID NO: 145780 - DNA, 834 bp, Homo sapiens
  misc_feature: GYAE6OF01DI34R.21.4.A04.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggccaccctgtctttgctaccgaaggggaagcgccaccctctcctgcagtcctccagccaagaactacnccagagtactaactacatacgcctaggtaaccagacgaagaacgccgtacggaccaacggtcctccccgtaggtttccctacaacttctaagtcggccgtccgggaccccaacggtacgggccctaacgtcgggacctaaccgtacccgaacggtaacggtacggtttacgaacggggttcggaccggttaacggggtttcggggttaccgtacgggggtaaacctaacgggttaaccctttccgtaaaccgttttcccgaacgttaaccgtttaaccgtaaacggtttaaccggaaccgtaacgggttaaaccggttacgggggaaccgttaacccgttaaaggttaaaccggtttacgtttttaaccgggaacggtttaacggtttacggtttaacgttttaaccggtacgttaaccgacgggtaacgttaaggttaaacggtttacggggttaaaccttacccgttaccgtttcggttaccggttacggttaaccggaacccggaaacgggtaacccgtaaagggtaaactaaaacggtacggtaaaaacgtacgtggtacggtacctacggaccaaactgttcgttacg

SEQ ID NO: 145781 - DNA, 876 bp, Homo sapiens
  misc_feature: GYAE6OF01DSKY3.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaattgtgttgacgcagtctccaggcaccctgttctttgtctcgaggggaaancgccaccctctcctgcacgcctccgacgccaagaactactccaagacgtcctaactacagtacgtccgtcggtaaccagacaaggaacgtccgtcggaccgacggcctaccccgtacggttccctactaacttccgttaacgtcggtcccgttaccggggtacccccaacgggtaccggggtaccctaacggtcgggtaccctaaccgtaccccgaaggaccgtacggtaccttaccgggtaagggtcggaccggtaaggggttccgggggttaccggtacggggtaaccgtaacggtacccctttaccgtacctttacctacgtaacttaacgtaacgttaacggacgtaaacgggtacggtaggggtaaccgtaacccgttaagggtaaacggtttcgtttaccggaacgtttaacggtttacggttaacgtttaaccggtcgttaccggtaagtaaccggttaaggtttaaggttacgggttaaacccttttcgtaacccggtttcggttacccgggtttacccggggttaacccggaaaccgggtaaaaccggggttaaaccggttaaaaacggggtaaaacgttaaacgggtaaaacggttaaaacccggttaacggttacgggttaacgggtaccgttaacggtaacccctaacgttcgtttaacccgg

SEQ ID NO: 145782 - DNA, 591 bp, Homo sapiens
  misc_feature: GYAE6OF01BX1G3.21.4.A04.1.454.CMB.1.raw
  modified_base (308)..(308): a, c, t, g, unknown or other
  misc_feature (308)..(308): n is a, c, g, or t
  modified_base (463)..(463): a, c, t, g, unknown or other
  misc_feature (463)..(463): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccagccgtggagggtccctgagactctcctgtgcagcctctgctattccaccttcagtcgaccacaacatggactcgggtccnccgaggcctaccgaggggacgggctgggagtgggtcgcgtatacgaaaggaagctaacagttacagtacagaatcggcgtcgtcgtgtaggaaacggtaggtcaacctatacgtacaagagatagattacaaagaactcaactgtactctagaanaaactacgaacacgtaccgtaaggaaaacccggtaggacgaccgggcgttagtattacgttgggtacggtaagaaacgtaaaaggtagggtaggagttagggtacggtagggtagtcgtggttaacgg

SEQ ID NO: 145783 - DNA, 896 bp, Homo sapiens
  misc_feature: GYAE6OF01BK5ET.21.4.A04.1.454.CMB.1.raw
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (878)..(878): a, c, t, g, unknown or other
  misc_feature (878)..(878): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggatacgttggtccagtccgtgggacgggtcccctagacgactcgtcctgtgcacgtccctntgcctattccaccttacgaggtcaaccctacgaaaacncgttcgggaaccggttcggggttaccccgccgtagggtacccgttacccggaaggggggtaacgggggtccgtgggggaacgggtttcggggtacccgggtaccgtttaaacggtaaccggtaaaagggaactaaccgttaaaacgtaacggtttaaccgaacggtaacgtaaaacggtacggttaacccggggcgttacccggttacggtaaggggttaaacggaaaaacggggggttttaccttaaccccaaaaccccgtaggtttaccccaaagggaaaagggtaggaccggtttaaactaccggttaaaaccggtaaaacgttaaacccgtaccgtaccggttttatacgttaccccgtaaggtaaacccaaagtttaaccgggaaactaaccccgtaaccggttaaaaacggaaaacccccggggttacggaaccggttaacccggaccgggtttttaattttaaaaccggttcgggttttaaccggaaggggtaaaactaaaaaccgggaagggttagggttaacccgggtagtttggggggaaggtttaacggggtcncggttttaacggggaacc

SEQ ID NO: 145784 - DNA, 714 bp, Homo sapiens
  misc_feature: GYAE6OF01BLLPR.21.4.A04.1.454.CMB.1.raw
  modified_base (200)..(200): a, c, t, g, unknown or other
  misc_feature (200)..(200): n is a, c, g, or t
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagaaattgtgttgacgcagtctccgagccaccctgtctttgctccgaggggaaangcccaccctctcctgcacgcctccagccagaatactccagacgctacaacagtacgcctggaccagcaaggacgcctggccaggcctccgaggttccacattctatcgcgtcgggtacccagtcgggtcccagtcggactaccgtccgaaggtaccgtacgggtttcaacgggtggtacctaggggtcgggttaccgnggggaacctaagtcccgtttacacgtttcgaccaagttccgaattacggactaacgggtacctcggggaactcccggtaagtaaccgtacgttttccgaacgtagtttagtactttacgtcgttacgaaggtcgtaacgttaggtaaggttaacgttccctacccgttagttacgggtaccgtttaccgggaaccgggtaaacgggaaacccggttaaagggtaaacgttaaacgtaccgggttaaaaacgggacgtttagggtccggtaaaccgttacgggaacccttaccgtaaaggtttcccgtttaacccgg

SEQ ID NO: 145785 - DNA, 699 bp, Homo sapiens
  misc_feature: GYAE6OF01BWX9W.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaancgccacctctcctgcagctccagccagaatactccagacgctaactacatacgcctaggtaccagcaagacgcctggaccgaggtcctccccgtaaggtttcccctagacgtttacctaagtccggtcgttccggggtaccccaggaccggggccctaacggtcggacctaccgtcccgaaggtacgacggtttaccgagggtcgggaccgtaggggtttcgggtaccgtagggaacctaaacggtccgtttacaccgttctacctaatcctaacgtttagacgtaacgtacgtaggacgtcccgtaaggtaacgttacgttacgaccgtaggtttctaacgtttcgtgtacctaaggtaccgtaggttaacgttagggaacctttctaccgttccgtttagtcccgggttacgaaccggtaaagggtacccgtaaaggtacgtaaacgtaaggaaaccggtaggttaggacggtactacggtccaaaccgtgttcgttacg

SEQ ID NO: 145786 - DNA, 770 bp, Homo sapiens
  misc_feature: GYAE6OF01CMA64.21.4.A04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagagtagtgatcagggggagagctgctcagttaggacccagagggaaccatcggaaaccccagcgcagcttctcttcctcctgctactctggcctcccaggctacgaacgaaaccgaccggaagtaaattggtgttgaccgcagtcctaccaggcctaccctggttcctttgcctaccggaaggggaaancgcccaccctctcgtgcacgcctaccgagaccaaagtaatacgtaccgaaggactacctaaactaacacgtaccggtcccgttacgggaacccaggaccgaaggtaaccggccgtaggccgtaacggtccctaccgtaggttcccctagtattctagtcgaccgtacgggtcccaggaccggccacgtcggactacggtcccagtaccggtagttacgaggtcggactagggtcggtaccgaggacctaggtcctttacgacgtactacgtactacctaagtacgaccgaagtacgtaggtacgtacgttaagacggttacgtacgtacgtaacggttacgttaacgttaacggtcgtaaccgaaggttccgtaaagggtttacgtaaaccggggttaaccttacccggttaccgttacggttaccgggttaccccggttaacgggaaacccggttaaacggggtaacccttaaaggggttaaacaaaacggttaacgaaacggttcgtacgggtacgtacgactaccgtactacgttcgttacccg

SEQ ID NO: 145787 - DNA, 711 bp, Homo sapiens
  misc_feature: GYAE6OF01AXKH7.21.4.A04.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgcccaccctctcctgcagcctccagccagaatatccagagctactacatacgcctggtaccagcagaacgcctggccaggcctcccgaggttccctanactcgtatcggccgtcgggtcccagacgggcccagtcggcactccgagacctaggttcaggtcggacgtagggtcgggtctaggggaactcggtaaccttcgaccttctcgtatccgtaagtacgacaacggtaccgtcggacgtaccgttaggtaacgtacttttaccggacgttagttacggtttaactttacgtacggttaccgtaacgtacgttaacggttaagtacggggtttaacgtttaccgtaacccgtttacggttcggtttacccgggttaccggtaaccgggtaaaaccgggtaacccgtaaacgggtttaaacgtaaaacggttaaccgggtaaaaccggttaacggttaacgggtacgggtaccttacggacccgtaacccttagttacccgttacgg

SEQ ID NO: 145788 - DNA, 973 bp, Homo sapiens
  misc_feature: GYAE6OF01C5NKE.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttcctgttgttatttacaggtgtccagtgtgaggtgcagcgtgggtggagtcggtgggggagtacgttcgggtccagtcccgtagggacgggttcccctggacgacccttccgtccgtggtcgcgacgtcccgttcgttcggaccttaactttaccctaccctttttaccgaacggttaccggaaaacccctaaaccgtaaaaccgtacggttaccgggggtaacccgtttccggggggttcccccgaccggtaaacggggtacccggttaccccggggaaggggggtaaacgggggtcccgttagggggacggggtttccgggggtaccgggtacccggttaaagtttaaaccggaaaggtaaaaccgtacgttaaaaccgtagtttaaccgaaaggtttaacgaaaggtaaacgtccgggtacggtacggttacgttacgggtaaacgggtaaaacggggttaaccggttacccaaacccgttaagttacccgtaaggtaaacggtaagtaacttaaggtaaacctttaaacgaaaaccggttaaaccttccgtaaaccgttcggtttaaacgttaccgtaagtaaacgttaaacgtaacgaaaaccggtacccgtaaaccggtaaaccgggtaaaaaccggaccgggtaaccggaaacccgggtttccggtttaaaagttaacccggttttaaaggttaacggggttaaaacgggtaaaaccggttaaaacgggaaaaacggttggggttaaaggttaacggggtttaacggggttagggttaaggtttaacgggttagttacgggttaaacccgg

SEQ ID NO: 145789 - DNA, 697 bp, Homo sapiens
  misc_feature: GYAE6OF01EEPJS.21.4.A04.1.454.CMB.1.raw
  modified_base (149)..(149): a, c, t, g, unknown or other
  misc_feature (149)..(149): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccgganaaattgtgttgacgcagtctccgaggccaccctgttctttgtctccgaagggaaagcgcccacccttctcctgcacgcctccacgccaagtaactactccgagacgtacttactaacatacgccgttaggtaccagacaagaacgcctggccaggcctccgacggtttccacacttctgtcgcgtcggtaccacgcggccagtcgctacgccagtacgagttcagtcgcgaggtcggtacgtggactacgtaccttcaaccgttcgtactaactcgttaacgttacgaccgtaacggtacggtacgggtacgtacgttaaggtaaacgttagtttaccggacgtaagggtttacttacggtttactacggtacgtacgtagtaaggttacgtacggggtttaaacttcccggtaacgtttcgttaccggtttccgggtacccggtaaaccggtaacgggtaaacgtaagggtaaacgtaaacggttaacggtaaaaccgtacggttcggacgtaccgttaacgaacccttacctacgtttcgttaccg

SEQ ID NO: 145790 - DNA, 682 bp, Homo sapiens
  misc_feature: GYAE6OF01B6CJ1.21.4.A04.1.454.CMB.1.raw
  modified_base (201)..(201): a, c, t, g, unknown or other
  misc_feature (201)..(201): n is a, c, g, or t
  modified_base (320)..(320): a, c, t, g, unknown or other
  misc_feature (320)..(320): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgtctccgaaggggaaancgccaccctctcctgcagctccagccaagaactatccagagctaactacatacgccgttaggtaccaggacaacggaaacgcccgtaggacccaagggccttaccccgaggtttccctnaacttctatcgcgttcgggcccaggacgggcctaacggtggctacgtcccgaaggacctaacggttcaaggttggacgtagggtcgggtacgtacggggaacacgtacttcgaactctacgacttacaagttacgacgagtacgtgggacgtacgttaggaacgttnttaccggntaagttacgttaatttaccgtgttaaccgaggtactaaggttacgtaacgggttaacttcctacgttacgttcgttaccgggtcggtaaccgaaacggggtaaaccgaaggttaaacggaaaagttacggaaaaccggttacgtgggttacccggtacgtacggaaccctaacgtacgttcgttacg

SEQ ID NO: 145791 - DNA, 811 bp, Homo sapiens
  misc_feature: GYAE6OF01CNLFE.21.4.A04.1.454.CMB.1.raw
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacaaggtgtccagtgtgaggtgcagctggtggagtcgtggggganacttggtccagccgtgggacgggtccctggacgactcctcctgtgcagccctntcgactattccaccttcacgttcgaacccaacaaccagtagggaccgtcggggtacccgcccgaaggccctaccggaagggggaacgggggtccgttaggggaacggttcgggggtccgggtacccggttaacgttaaccgaaagggtaaacgtacccttaaacgtaacggtttaaccgaacggtaacgaaggtaacgtaccggggaccgtaccggttcgtaggtaacggaaacgggtaacggtttaccaacccgtaataccgtaacgaaacgggtagaacgttaagtaacgttaacgaaaaacgtacccgtacgtaacgttaacgtaacttaccgtaacgtaaactaaaagtacgaaaccgtaaccgggtacccgaaacgggtaaaaacccggtagggacccgtaaccggggtcccgttaaggtttaacgtttaaggttaacgggtaacgggttaaagaaaaccggttaaaaagggtacgggtagggtttaggttaggggtacgggttagggttaaagtcccgggtttaggtaacccggg

SEQ ID NO: 145792 - DNA, 600 bp, Homo sapiens
  misc_feature: GYAE6OF01A7P7F.21.4.A04.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (515)..(515): a, c, t, g, unknown or other
  misc_feature (515)..(515): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagacgctactacagtacgcctcggtaccagccgagaacgccgtggccaggcctcccgaggtttcccncgacttctactcggccgttcggggtacccacgtacggggccctaacgtgggaccactaccccgaggaccagggtttccaagggtgtacgagtcgggtcgagggaccagtacttcactctcntctatacgcagtacgtagtacgcgtagaacgtnttacgntaggtcgttatcgtgtacgacgacgtaagtagtaggtaacttccaaccgttnttcggtacgtcggacgtaaacggacggtaaaggtacgaaagtacgaaacgacgtggtacgtcgtacgaccaacgtcgttcgtacg

SEQ ID NO: 145793 - DNA, 1078 bp, Homo sapiens
  misc_feature: GYAE6OF01CM7AL.21.4.A04.1.454.CMB.1.raw
tcagtcgtcgctcgcacgaccggtgctcgatttagagtagtgatcaggggagagctgctcagttaggacccagaggaccatggaacccagcgcagcttctcttcctcctgctactctggctccaggctcacgaaccacggagaattcgtagttgacgctagtctcgaggcctacctggtctttcgtctaccgaaggggaacgcgaccaccctctccgtagcctagcctaccgaggacctaacggaatactccgaagacgtaccaactacacgttacgccttacggaaccacggacaaggtaacgccgtcggaccctagggtaccccttccggaacggttttcccacctaacgtttccgttacgccgggtttacccgtaccgggggttaccccgaacggttaccggggtacccctaaaccgggttgggaacccctttaccggacccgtaaacgggtacccgttaacggggtttacctaacggggttccggggaacccggtttagggggtacccgggggtttttaccgaaccggggggtaaaaccctttacccgggggtttaaacccgtttacccggggtaaccctttacccggttacccggtaacgtttaccccgggttaaacgttttaacccgggtaacgggttaccggtttaacccgggttaacgggttaaaccccggtacggttttaaaacgggggttaaaccgttaccggttttttaccgggaacccggggttttactttaaacggggttttaaaccctttttaccgggtacggtttaaacccgggtaacggttaaccggtttaaaaccggggttttaccgggttaaacccgggttaccgtttacccggttaaacggttttcccgggtaccggggtttaaacccggttaccggggtaaaaccccggggttaaccggggtaaaaccttaaccgggggtttaaaacgggttaaaccccgggtaaacgggtttaaaacccccgggttaaacgggttttccggggtaaacccgggttcccggttaaaccggttaaacccccggtcgttttaaacccggttcccggtttttaaaaccggg

SEQ ID NO: 145794 - DNA, 682 bp, Homo sapiens
  misc_feature: GYAE6OF01CPUNQ.21.4.A04.1.454.CMB.1.raw
  modified_base (486)..(486): a, c, t, g, unknown or other
  misc_feature (486)..(486): n is a, c, g, or t
  modified_base (674)..(674): a, c, t, g, unknown or other
  misc_feature (674)..(674): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctccaggctcaacgaaaccacggagtaaattgtgttgacgctacgtctaccgaggcctacccgttgtcttttcgtaccgtaccgaaggggaaacgacgaccctaccctcctacctgccacgcctaccacgtaccaagtaactactaccgagacgtacctaacacagtaccgtcgtaacggtaccaggaccaaggtaacgcccgtacggacccgtacggtcccctacccggttacggttccctactacgttctagtccgtccggtccggtacccgaggacgggacccacggtcgaccacgaccgagtacgtagtcgaggtcgacgtagggtcggttcgacggtacacgtactctactctactntactagttaacgtagacgtcgacgtacgtaagtaattccgttaccgagttacgttataccttagtagactaggtactaaggtagttaacgtcttacgtaccgttgttacgggtacctagggtaaccgaacggtacgtaaagtaaggaaaacgtagtaaacggtcgttgcggactacgaccgtatcgtntcgttacc

SEQ ID NO: 145795 - DNA, 679 bp, Homo sapiens
  misc_feature: GYAE6OF01A66MX.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgcccaccctctccctgcagcctccagccagaatactccagacgctaactaacatacgcctaggtaccagcagaacgcctggccacggcctcccgtacggttcctcactctacgtcgtcgtcgggtcccacgacgggcctacgtggaccactcccacgactaggttcaggtggcgaggtgggtcgtggggacacggtcttactactcgtactagtctaacgttagacgtacggtacgtacggtacgtaccgttaagtaaacgttacgtttaccggtagtaaggttacgtttacgttacgttacgtcgaacgtacgttaaggtaacgttacgggttaaccgtttctaacccgtttacgttcgggttaccggttacgggacccgtaaacggggaacccgttaaacgggtaaacggttaaagtaacgggtaaaccgaacgttgggtacggtactacggacctaccgttcgtcgtttacgg

SEQ ID NO: 145796 - DNA, 842 bp, Homo sapiens
  misc_feature: GYAE6OF01C2TXJ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttcttgttgtttatttacaaggtgtccagtgtgaggtgcagcgtgggtggaggtcggtgggggagtacgttggtccgagtccgtgggacgggtcccctggacgtacgtcttccgtggtcgtcgacgtcccttcgtcgacctacgttccctaccttccgacggttaccgaaaccctaaccaaacgtacggtacgggtaaccgttcgggggtccccgaccgtacgggtacccggtaccgggaacgggggtaacggggtccgtaggggtaaggggttcccgggggtaccggtaccggttaaagttaaccggaaaggtaaacgtccttaaaacggacgtttaacgaaagtaacgaacggtaacggtaccggcgtacgtcgtaggtaacggaaggtacgtccaacgtactacgtagaagtacgtagtacgtaacgttaacgaaagtaaccttacgtaaccgtttagttaacgttccgtaagtaaacctaaagtaaccgaaacggtaaccgtaaccggtaaacggtaaaaccccgggtaaggtacccgggaaccgttagggtaaccgtttaaaggttttacgtacggggttaaacggtaaaggttaaaacgggtaaaggttagggttaaagggttacggttacggggtttaaggggtttaccgggttaacgggtccgttaagggtacccgg

SEQ ID NO: 145797 - DNA, 710 bp, Homo sapiens
  misc_feature: GYAE6OF01B8U8R.21.4.A04.1.454.CMB.1.raw
  modified_base (200)..(200): a, c, t, g, unknown or other
  misc_feature (200)..(200): n is a, c, g, or t
  modified_base (324)..(324): a, c, t, g, unknown or other
  misc_feature (324)..(324): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgttcttgtctccgaggggaaancgccacctctcctgcagctccacgccaagaatcgtaccgagacgccttaacgtacagttacgccgttaggtaccagacaacggaacgccgtcggccacgggccttaccccgtacggttccctanacttcgtactcggtcggttccggtacccgaggaccgggtacctacggtcggacctacgtcccgaagtaccgtaggttcgaggtcgggacgtaggtttgggtacgtaggggacctacggtacctttacgaccgttacttcaagttactagttacggacgtaaggtacgtggtaacgtacgtaaggtaacgttacgttacgacgtaagtttacgttaagttacgtacgtaccgagttaaccgtaagttaaccgttagggttacttaccttacggttccgttacgggtaccgttaacgggacccgtaaaggggtaaccgtaaagggtaataaaccggtaggtaaacgtagttcgggtgtaccggtactaccctaagttcgttcgttacg

SEQ ID NO: 145798 - DNA, 783 bp, Homo sapiens
  misc_feature: GYAE6OF01COFFM.21.4.A04.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagctctgagagcggagccccagccccagaattcccagtgtttcatttggtgatcagcactgaacacagaggactcaccatggagtttgggctgagcgtggttttccttgttgttattttacaaggtgtccagtgtgaggtgcagctggtggagtcgtgggggagacgttggtccaggccgtgggacgggtccctaggacgtacctcctccgtggtcgcncgccctgtcgctacttcctacccttnacgtacgaaccaacaacgtacgtgggtaccgtcggggtccccgaccgacgggtccgtacccgggaaggggtaacggggccggttaggggaacgggttcggggtccgggtaaccggttagttaaacggaaaggtaaaccgacgtaaacgtacgtttaacgaacggtaaaccaaggtaaacgttaccgggcgtacggttaccgtagggtaacggtaaacggggtaacggtttaccaaccgtaacgtaccgtaacgaaagtagtaacgtaagaattaacgaaacgactaccgtaattacgtaacttactacgtaacaagttaaccgaaccgaacgtaccggtaaacgaaacccggaacggtaccgaaccgggttaccgttaggttaaacgttttacggttagggttaacgggtaaactaaacggtaaaacgggtagggttaacggtagggttacgggttaaggttaggggtaactggttaacggtaaccgg

SEQ ID NO: 145799 - DNA, 705 bp, Homo sapiens
  misc_feature: GYAE6OF01BAUUA.21.4.A04.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (695)..(695): a, c, t, g, unknown or other
  misc_feature (695)..(695): n is a, c, g, or t
tcagtcgtcgctcgcacgaccggtgctcgatttagagtagtgatcagggggagcctctgagagcggagccccagccccagaattcccaggtgtttcatttggtgatcagcactgaacacagacggactcaccagtggaggttgggctgagtcgtgggttttctgttgttatttacagtgtcagtgtgaggtgnagcgtggtggagtcggtgggggntacgttcggtccagtccgtgggacgggtccctggacgtactccgtcgtggtcgcgacgtccctgtgactacttccgtaccttcgagtcgaaccctaacaactacgtagggtaccgtcggggtcccgaccggacgggtcctacccggaagggggtaacgggtcgtggggtaggtcggggtcggtaccgtaagtaaacgaaacggaacgtactaaacgttagtacagtaacgaaggactacgggcgtcgtactagggtaaggaagggttagtaccaacgactacgtacgaaggtacgatacggaattaacgaaaggtactacgacgttagtacttacgtacgaactaacgaacgtacgacgttaacccgtaaacgggaaaacccggcggggtaacctccggggtaacttacggttaagttacgtagggtacggtaagtaaacggaaagtcgggtagtaacggtgggtaacggtggtacgtntagggtaccg

SEQ ID NO: 145800 - DNA, 752 bp, Homo sapiens
  misc_feature: GYAE6OF01ENNPW.21.4.A04.1.454.CMB.1.raw
  modified_base (199)..(199): a, c, t, g, unknown or other
  misc_feature (199)..(199): n is a, c, g, or t
  modified_base (340)..(340): a, c, t, g, unknown or other
  misc_feature (340)..(340): n is a, c, g, or t
  modified_base (543)..(543): a, c, t, g, unknown or other
  misc_feature (543)..(543): n is a, c, g, or t
tcagtcgtcgctcgcacgaccggtgctcgatttagagtagtgatcaggggagagctgctcagttaggacccagagggaaccatggaaaccccagcgcagcttctcttcctccttgctactctggctcccaggctcagaaccgacggagaaattgtgttgacgcagtctccaggctaccctgtctttgctcgaggggaanacgccaccctctcctgcagccgtacccaggaccaagaaactacgtccgaagacgccttaactacagtaccgccgtacggtaacccaggaccaacggaacgtccgttggacccaaggccctaccccgtaacggtttccctanacttcgttagtcggtcgtccgggtacccacggacgggccctagcggacctactccgagacgtacggttcgaggtcgacgagggtcggtacgtagggaactacgtacttcgaccgttctacgtaacttcgtaacgttacgacgtacgtaacggtacggtaccgacgtaacggtaacgttacgtttacggacgttaaccgggttnttaaccgtttaacgtcgtaccgtaagaccgttaaggtaccgttacggggttaacgttacccgtaccgtttccggtacggttcccggttaaccgggtaaccggtaaacggtaacccgttaaaagggtaacccgtaaaaggtaacgggtaaaacccgtacggttacggtaccggtactacgggtaacccttaacggtcgttccgttaaccg

SEQ ID NO: 145801 - DNA, 743 bp, Homo sapiens
  misc_feature: GYAE6OF01AOT97.21.4.A04.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgtctttgctccgaggggaaancgcccaccctctccctgcagcctccagccagaactntccagcgctactacatacgcctaggtaccagacaaggaacgccgtgggacccaggtccctcccgtaggttccctactactactagtcggaccgttcgggtacccacgacgggcccaacgtcgggacctcgtacccgagtaccgtacggttcgaacggtggacgtacgggtgggtcgtaggggacctaacggtaccttacgaaccttcctactacgtacgttaactacggaccgtacggtacgtacgggaaccggcgtaacggttaaacgtcgtttaacgccggtaaggtttacgttaacgttcgttagtacgtaaggtaccgttaaggtacggttaacggtaacgtttcccgtaaccttcccgggtttacggttcccgggttaacccgggtaacccggtaaacggggtaaccgtaaaacgggggttaactaaaacggtaaccgggttaaaaccgggtaacgttagggtaccgtacggacgtacccaacgttacgttccggttaaccg

SEQ ID NO: 145802 - DNA, 847 bp, Homo sapiens
  misc_feature: GYAE6OF01DO2VH.21.4.A04.1.454.CMB.1.raw
  modified_base (213)..(213): a, c, t, g, unknown or other
  misc_feature (213)..(213): n is a, c, g, or t
  modified_base (308)..(308): a, c, t, g, unknown or other
  misc_feature (308)..(308): n is a, c, g, or t
  modified_base (833)..(833): a, c, t, g, unknown or other
  misc_feature (833)..(833): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggcctcaacgaaaccaccggagtaaattgtgttgacgcagtctccaggcctaccctgttctttgtcctaccgaaggggaaacncgcccaccctcgtccctgcacgcctaccagccaagtaacttactcccagagtacctaactaccatacgcccgtcggtaaccaggacaaggaaccncccgtcggaccgacggcccttaccccgaacggtttcccacgtaacttcctagtcggtccggttccgggtaccccaggtaccgggaccctacggtacggacctaaccgtcccgaacggaccgttacggtttaccgagggttacggacggttaacggggtcgggttaccggaggggaaccctagggtttacccctttccgtaaaccgttccctagtaaccgttaccgttaacgtttaccggaccgtaaggtaacccgttgggtaaccgaccgttaaggtaaacgtttaccgttttacggacgttaaggttttacggtttaaacgtttccgaggtttaacccgagggtaaacctttagggttaaacggtttaccggggttaacccgttttccgtaacccggttttgtccgggtttacccggttaacccgggaccggtaaaacgggtaaccggtaaagggtaaaacgtaaacgtaacggtaaaacccgtacgtttgggaacccgttcggtaacctacccgttaaaccgnggtttcccgttacg

SEQ ID NO: 145803 - DNA, 837 bp, Homo sapiens
  misc_feature: GYAE6OF01B7BRR.21.4.A04.1.454.CMB.1.raw
tcagtcgtcgctcgcacgaccggtgctcgatttagagtagtgatcaggggagctctgagagcggagccccagccccagaattcccaggttgttttcatttggtgatcagcactgaacacagaggactcaccagtggagtttggctgagtcgttgggttttccttgttgttattttacaggtgtctagtgtgaggtgcagtctggtggtagtcgtgggggatacgttggtaccagccgtgggacggtcccctggagtactccgtcgtggtcgcacgcctactgctacgttacctacttcagtacgaaccacaaactgcggtacgtccgggtcccacgacggccgtaccggaaggggtaacgggcttaggggacgggttcgggtaccggtaaccgttaacgttaaaccggaaaagggaaaccgaccgtttaaaacgtaaggtttaaaaccgaacggttaaaccggaaaggtaaacggttacccggggaccgtacggttacggttaggtaaacgggtaaaacggggttaacgttacccgaaccttaacgtaccgtaaccgtaaagggaacgttagtaacggttaaatttaaccgaaaacggtaaccttacgtaaccgttaagttaaccgttaccggttaacgtaaacgtaaaacgtaagaaaaccggtaccgttaaacccggtaaacggtaaaaacccggtaacggaacccgtaaccgggttacccggttaagttaagttttaacggttaacgggttaacggtaaaagggtaaaacgtaaaacgggttggttaaacgggtagttacggggtaggttaagggtaacgtgttacgggtaacg

SEQ ID NO: 145804 - DNA, 706 bp, Homo sapiens
  misc_feature: GYAE6OF01EV23Y.21.4.A04.1.454.CMB.1.raw
  modified_base (145)..(145): a, c, t, g, unknown or other
  misc_feature (145)..(145): n is a, c, g, or t
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctgctccaggctcagaaccaccgganaaattgtgttgacgcagtctccaggccacccgttgtctttgtctccgaaggggaaancgcctaccctctcctgcagcctccagccaagaatactccagacgctaactaacatacgcctaggtaccagacagaacgcctggacacggcctacccgaggttcctacatcttagtcgcgtacgggtcccacgacgggccagtcgaccactaccgacgacgtacggttcaggtggcgtacgggtgggtccggtaggggaactacgggtacctttaccgacttaccgtactaacgttcgtaacgtttaacggaccgtaaggttaccgtaacgggtaacctccggtaagggtaaacgtaccgttttacggacgtttaaggttacgtttaacgtttaacgttaggtccgaaggccgttaaggtacggttacgggtaacttccgtacgttacgttacggttaccggtaccgggtaccgaaacggggtaaccgtaaagggtaagtaaacgtaacggtaaaaccgtacggttggtaaccggtcgtacgtaaccgtacgtaccgtgttaccg

SEQ ID NO: 145805 - DNA, 829 bp, Homo sapiens
  misc_feature: GYAE6OF01AOT9U.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcacgaaaccaccggagaaattgtgttgacgcagtctccaggcaccgtgtcttgctcgaggggaancgccaccctctcgtgcagcctccagtcccaagaactactccaaggacgcctaactacagtacgccttaggaaccagtcaacggaacgtccctaggggacccagggtccctccccgtaaggtttcccacgaacttccgtaatcggtccgttacgggggtacccccaaggaccgggggtacccctacggtaccgggaccctaaccgtaccccgaaggtaacccgtacgggtttacgaacgggtttcggggaacccgttaggggtcgggggttacgtaacgggggaaccctaagggtaccctttcccggaacccttcggtacaactttaccgaagtttaccggacctaacgggtacgttacgggaaacgtccggtacgtaaaacggttcctttacggaacgttaacggtttcgttaacggtttcgtacggtaccaacggtaccgttaagggttacgttaacgggtaaaccgtttaccctaccgtttacggtaccgggtttaccgttaccgggaaaccggggttaaacggtaaccgggttaaaagggttaaacggaaagttaaaccgggaaaaccgttacggtaacggggttcgtaaccgtaccggtacccgtaaacgtcgttaaccgtttacg

SEQ ID NO: 145806 - DNA, 746 bp, Homo sapiens
  misc_feature: GYAE6OF01B8HA9.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctaactacatacgcctaggtaccagcaagaagcctggaccaggcctcccaggttcctacattctagtcgccgtcgggtacccagacgggccctagtcgggctaactcccgaagacgaggtttccgaaggtcggacagggttcgggtctaggggaactacggtaccgttcaccgtcttacgactactagttacggactaacggacgttacggacgtacccgtaggtaaacggttacttttccggacgtaaggtttacgtttaacgtttaccgttagggttaccaacggtccgttaaaggttaacggtttacggggttaaaaccgttttccgtaacccgttggtttaccgggtttacccgggtttaacccgggaaccccggtaaaacgggggtaaacccgtaaaagggtttaaacggtaaaacgttaaacgggtaaaaaccggtaaccgttacgggttaccgggtaacgttaccggacccgttaaacccgtgtttacccgtttaccgg

SEQ ID NO: 145807 - DNA, 654 bp, Homo sapiens
  misc_feature: GYAE6OF01EN1EX.21.4.A04.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatanccaganctactacatacgcctggtaccagcagaagcctggccaggcctccccgtacggattcctcatctatcggtccgattcgggtccccacgacggggcccacgtcgcactccgaagacgaggttcaggttcggactagggtcggtacgtcgggacaggtaccttacgaacttcctactacgtactaagttacgcgtaacgtaccgttagggacgtccgttagaacgttattttcgacgttaaggttagttaacttacgtgttacgtaagcgtaaggttaactacgggttaacgtttccgtaaccgttcgttacggttaccggttaccggtaaccggtaaacgggtaccgtaaaagggtaaacggtaaagtacggtaaaaccggtacgtacggtacggaccgttacgtaccgtaaccgtacg

SEQ ID NO: 145808 - DNA, 794 bp, Homo sapiens
  misc_feature: GYAE6OF01D5T5H.21.4.A04.1.454.CMB.1.raw
  modified_base (255)..(255): a, c, t, g, unknown or other
  misc_feature (255)..(255): n is a, c, g, or t
tcagtcgtcgctcgcacgaccggtgctcgatttagagtagtgatcaggggagagctgctcagttaggacccagagggaaccatggaaaccccagcgcagccttctcttcctcctgctacgtctggctcccaggcctacagaaaccaccggagaaattgtgttgacgcagtctccaggccacccttgtcctttgtctaccgaaggggaactcgccaaccgtctcctgccgatccgtccacgccagaactctccganacgtctaactacagtacgtcctacgtaccagaccaagaccgtccgtacggccacgggcccttccgacgtttccctactacgttctacggtcgtacggttccgggacccctaggaccgggtcctaacggttccggacctaccggttacccgaaacggttacccgttaaagggttccctaagggggttacgggacccgttaaggggtttcccgggtacggttaacgggaaccgtaaccgtaccgttacccggaacttcgtacctagttacctaaggttacgaacgtaccgggttacgtaaacggtcgaacccgttaggtaaacgttaacgtttcccggtaggtaacgtttaacggtttgttaccgttagtaccgtagtaacgtaggttacggaagttacgttaccgttacgttggtaccggttaccggtacggtaaccgggtaacggtaaacgttaggtaaaacggtaaacggttaaacccggtaaagtaccgttacgggtaacccgttacgtaacgacccttacgtcgttaccgttaccg

SEQ ID NO: 145809 - DNA, 747 bp, Homo sapiens
  misc_feature: GYAE6OF01CF01P.21.4.A04.1.454.CMB.1.raw
  modified_base (217)..(217): a, c, t, g, unknown or other
  misc_feature (217)..(217): n is a, c, g, or t
  modified_base (639)..(639): a, c, t, g, unknown or other
  misc_feature (639)..(639): n is a, c, g, or t
  modified_base (646)..(646): a, c, t, g, unknown or other
  misc_feature (646)..(646): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagcccgtgggacgggtccctggagtacctcctccgtggtcgcacgtccctgtgcctactttcctaacccttcgagttaccgaacccaacaaacgagttcgggaaccgttcggggtccccgaccgaacgggtccctaccgggaagggggtaaacgggggtccgttaagggggaagggttcggggtaccgggtaccgtttaaagttaaaccggaaagggtaaacgtaacttaaaacggtaacgtttaacgaacggtaaacgaacgtaaacgttaccgggacgtccggttacgttagggtaacggtaaaacgggtaacggttacccaacgtacgttaaccgtaacgaaaggtacgtaagttacgtaactttaacgaaaacgtaaccttacgtaacttgtaactcgtagaaagtaanacgaaanaccgtaccgtaaacgaaaccggagaccgacggtacgttagtaagttagtggtaggtaagaaagtaaaggtagtggattgggtaggtagtacgtcgtgtacg

SEQ ID NO: 145810 - DNA, 1009 bp, Homo sapiens
  misc_feature: GYAE6OF01B3JG9.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggcctcccaggctcaacgaaaccacggagaaattgtgttgacgcagtcctcaggcctacccttgttctttgtcctaccggaagggggaaacgcgaccctaccccttcctccgtcgccacgtcctaccacgaccgtaaagtaaactactaccgaagaacgtacctaaactactaacgtacgtaccttacggtaacccgaaggacgaacgggaacgtcccgtacgggacccgtaacgggtccccttaccccggtaacggtttcccctacgtaactttaccgttaacggtccggtacccggttaccggggtaccccaacgggaccggggtacccgtaccggtacgggtaccctaacccgttaccccggaaggttaaccggtttacggtttaaccggtggggttacccggggtacggtttaacgggggttccgggggttaaccggtacggggtaaacccttaccgggtttaaccctttaccggtacccctttaacccggtaacgtttaaccgttaacggtttaaccgtaccggaaaccggtttacggtaaacgggttaaccgggtaaccttaaaccgggttaaggttaaccgttttaacgggttaccggtaaacgtttacgttttaaaccgttttacggtttaacccggttaggtaaccttaacggggtaacgtttaacggttaacgggttacggtttaaacccgtttacccgttacgttttaacccgggttaccgggtttacccggggtaaacccgtaaaaggggttaacccgggtaaaacggttaaacggggttaaaacggttaaacggaaacccgggttaaacggttacgttaccggggtacgttacccggttaactaacccggttactttacgttcgggtttaaccc

SEQ ID NO: 145811 - DNA, 797 bp, Homo sapiens
  misc_feature: GYAE6OF01AKZB1.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggaagaaattgtgttgacgcagtctccaggcaccctgtctttgtctccgaggggaaagcgcccaccctctcctgccagcctccagaccaagaactctaccagacgcctactacatacgccttaggaccagcagaacgcctgggcccaggcctaccccgtacggtttcccacgtacttctactcgccggttcggggtaccccacggaccgggccctacgtcgggacctacctacccgaacggtaccgtacggtttcgaacgggtcgggccgttagggtcggggtacgtacggggtaacctacggtacccttacgtacgtcctacgtacgtacctaagttaacggacctaagggtaccgttacgggaaccgttccgtaagggtaacgttacgtttaccggtacgtaggtttacgttacgttttaacgttcggttacctacggttaacgtagggtttaacgtacgggtttaacccgttaccgtacgtttaccggtttaccggttaccccgggtttaacggggtacccgggtaaaaccgggtaaccggggttaaaacgggttaaacgtaaaacgggttaacggtaaaacccggttaacggttacgggttaacgggtaccgtaccctacccggtaaaccgttcgtttcgttaacccgg

SEQ ID NO: 145812 - DNA, 883 bp, Homo sapiens
  misc_feature: GYAE6OF01CD7M2.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcacgaaaccaccggagaaattgtgttgacgcagtctcaggcaccctgtctttgtctaccgaggggaaancgccaccctctcctgcagcctccagccaagaatactccagacgctactacatacgccgtaggtaaccagacaaggaacgcccgtcggaccacggtcctaccccgtaaggtttcccactaattacctagtcgtaccggttccgggtaccccacggaacggggtccctaacggtacgggaccctacgtaccccgaaggaccgtaagggttaccgagggtacggacgtagggttcggggtaccgtacggggaactaacggtaccttaccgaccttccgtacattacgtaagttacgacgtaacggtacgtcggtaacgtaccgtaaggtaacgttacgtttaccgaacgttacggttacgttaactttacgtacggttaccaacgggttaacgtaacgggttaacgttaacggggtttaaccgtttaccccgttaacccgtttccgggttttaccgggttaaccccggggtttaaacccgggaaacccggggttaaaacccggggtaaaacccggggttaaaaacggggttaaaaccgggtaaaaaagggtttaaacccgggggttaaaaaaccggtaaacccggtttttaccggggggaacccgggttaacccgtttaaccccgggtaaaccccgtttaaacccggttaaacccggttttttacccgggtttaaaccccggg

SEQ ID NO: 145813 - DNA, 784 bp, Homo sapiens
  misc_feature: GYAE6OF01BHXHF.21.4.A04.1.454.CMB.1.raw
  modified_base (151)..(151): a, c, t, g, unknown or other
  misc_feature (151)..(151): n is a, c, g, or t
  modified_base (209)..(209): a, c, t, g, unknown or other
  misc_feature (209)..(209): n is a, c, g, or t
  modified_base (747)..(747): a, c, t, g, unknown or other
  misc_feature (747)..(747): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggaanaaagttgtgttgacgcagtctccaggccaccctgttctttgtctaccgaaggggaaancgcctaccctctccgtgccacgcctaccacgaccaagtaatactccaagactacttaactacactacgtccgtacggtaccagaccaagaacgtccgtacggaccacggtcccttaccccgtacggtttaccctactacttacgttacgtcggtaccgtccgggtacccaacgggaccgggccctaacggtcggacctaaccgttacccgaacgtaacgtacgggttacgagggttcggggacgtacggggttcggggtacgtacggggtaacctaacggtaccgtttaccaccgttaccgtacgtaacgttaccgttaacggtttacggaccgtaacgggtaccggtacgggtaacgtacccgttaagggtaacggtttacgttacgtacgttagggttactttaacgtttcgtaacgttacgacggttacgtaagtttacggtacggttaacctttcgaaccgtttggtaccggttacgggtaaccggacgtaaacgggtaaccgtaagggtaaacgtaaacgtaacggtaaacgngtacgggtacgtacgtacaccgtactagttcggttac

SEQ ID NO: 145814 - DNA, 814 bp, Homo sapiens
  misc_feature: GYAE6OF01CTT3H.21.4.A04.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
  modified_base (768)..(768): a, c, t, g, unknown or other
  misc_feature (768)..(768): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcgttgggttttccttgttagttatttacaaggtgtcagtgtgaggtgcagcgtggnggtacgtcggtagggggagtacgttggtaccagccgttgggacgggtccctgacgtactccgtctgtcgcacgtccctntcgactacttccaccgttcagtacgaaccaaccaactagtggaccgtcgggacccgccgtacggtaccgtaccgggaaggggaacggggtcgtgggggtacgggttcggggtaccggtaccgttaagttaaaccggaaaggtaaaacgtaacccttaaaggtaaacggtttaaacccgaaaggttaaccgaaacggttaaaccgggtacccgggtacggtacccggtttagtaagggtaaccgggtaaaaagggggttaaccggttacccggtaaaccctaacgtaaccgtaaccggtaaaggtacgtaaagttaacgtaaacgtttaaccgaaaaacggtacccttaaccggtaacttaacgttaacgttaccgtaaaggaactttaaaacgaacggaaaccgtaacgtacccttaaacgggaaacgacggaaccgtaacgtccggttataacgttagttgggtaaacggtaagaaacgtaaaggnggttaacggtgtacgggttagggtaggtacgtggttacggtaacgg

SEQ ID NO: 145815 - DNA, 750 bp, Homo sapiens
  misc_feature: GYAE6OF01CCB7B.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaggtgtccagtgtgaggtgcagctggtggagtcgtgggggagtacgttggtccagccgtgggacggtccctgacgtactccgtcctggtcgcacgcctctgctacttcctaccttcacgtacgaccgaacaacagtcgggaccgttcggggtcccgaccgaacgggtccgtaccgggaagggggaacgggggtcgtagggggacggtttacgggggtaccgggtacccggttaagttaaaccggaaagggtaaaacgtacgttaaaacgtacggtttaaacgaacggtaaccgtaaggtaaacgtaaccgggtcggtcgttacgtaagggtaaacggtaaacggggtaacggtttaccaaccgtacttaccgtaacgtaaagagtaactgtaaattaacgaaagtaacctaccgtactaggttactactacgaataaactaacgaaccgacgtaaccgtaaccggaaaacgacggaaccgacggtcgtaagttacgtaaggttacggtaggtaaacgtaaacggtaaaaggacggttaggttaacggtcggttagggttaggtacgtcgttggtacg

SEQ ID NO: 145816 - DNA, 773 bp, Homo sapiens
  misc_feature: GYAE6OF01CVNOY.21.4.A04.1.454.CMB.1.raw
  modified_base (192)..(192): a, c, t, g, unknown or other
  misc_feature (192)..(192): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccaccggagaaattgtgttgacgcagtctcaggcacctgtcttgctcgagggaancgccacctctcctgcagcctccagccaagaactactaccagacgtctacactatacgccgttacggtaaccagacctaaggaacgtccgtacggacccgaacggtccctaccccgtaagggtttcccctacgtaacttccgtaactcggtaccggtaccgggttaccccaacggacgggtaccctaacgttcggacctaaccgttccccgaaggaccgttacggttacgaacggtggacgtagggttagggtccgtaggggaacctacggtacctttaccgaccgttctaacgtacgttaacaagtttaccggaaccgttaacggacgtttcgggaacgttacccgttaaaggtacgtttacgttcccgggtaactaagttttacggttaaccttttacgtacgttaccgtaagtaccgttaaggttaacggtacggttacgtttccacgttcggtacggttccggttaaccgacgtaaacgggtaccgtaaagggttaaacggaacttaacgggaaaaccgttacggttcggaacgggttacccaaacggtcccttaaaaccgttgtttcccggttaacg

SEQ ID NO: 145817 - DNA, 782 bp, Homo sapiens
  misc_feature: GYAE6OF01AYC72.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaagaaaccaccggaagaaattgtgttgacgcagtctccaggccaccctgttctttgtctccgaaggggaancgcccaccctctccgtgccagcctccagaccaagtaaactactcccgaaggacgtaccgttaacctaacaacgttacgcccgttacgggtaacccaagaccgaaggaaaccgtcccgtacgggacccaagggtcccctaccccggtaaggtttcccctacgaacttccttacgtaccggtccgtaccggggttaccccacggacgggccctaacggttcggacctaacgtacccgaggaaccgtaggttgaacggtcgggacgtagggtcgggtacgtcgggaacctaagtccctttacgacttcctacgtatacgtacgttacgtaccgaagtacggtacggtaacggaccgtaaggaaacgttacgttacgtacgtaacggtttacgttaacttacggttacgtaacgtacggtgtaacggttagttacggtaacgttaccgttacttaccggttccggttaaccgggttacccggtacggtaaaaccgggtaaccggtaaaggtaaacggttaaatacgggtaaaacggtacgtaacggtacggtacgtacggacctaacttacgtcgttacg

SEQ ID NO: 145818 - DNA, 795 bp, Homo sapiens
  misc_feature: GYAE6OF01EQF0G.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcacctgtcttgctcgaaggggaancgccacctctctgcacgctccagaccagtaactactaccagacgctaactacatacgcctagggtaacccagtaccgaagtaacggcccgtagggacccaagggtccccttaccccggtaggtttccccacgtaacttcgtaacgtcggaccgtttccggggacccctaacgggtacgggcctaacggtcggtacctaaccgtcccgaaggtaaccggtaggtttaccgaagggtcgggtaccgtaaggggtttcgggtacgtagggaacctaacggtaccttaccgacttcgtaccagttaccgtaagttacgactaacgggtacgtacgggaccgtaccgtaagggaacgtttacttaccgggaacttaaggtttacgttacgtttaccgtggttaaccaagggtccgttaaagttaccggtagggttaaaccgttcccgttaacggttccgtttacgggtacccggttaaaccggtaccggaaaacggggtaacctaaaaggggttaacttaaaccggtaacggtaaaaaccggttacggttcgggtaacgtacccgaacggttaaccccacgtttaaacgtcggtttaaacccg

SEQ ID NO: 145819 - DNA, 733 bp, Homo sapiens
  misc_feature: GYAE6OF01BXIDV.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggacgggtccctgagactctcctgtgcacgcctctgctattccaccttcagtacgaaccacaacgagtcggacgtcggggtcccgccgagggcctaccggaagggggaacggggcgtaggggagggttcgggggtaccgggtaccggttaattaaccggaaagggaaacgtactaaacgtacggttaacaaggtaacaaggaacgtaccgggcgtacgtcgtaggtaaggaaagggtacgtttacccaactagttcctacgaaaggtagtaatagtaaatttaccgaaaaaggttacctccgtaattcggttaactccggtaagaacctaaagtacgaaaccgtacggtaaccctaaaggggaaaaaccccggtggaacccgtaccgggaccgtttagttaaagtttaacgttgggtaaacgggtaacaaaacggtaaaagggtcggttaggggaaagtttgggttaacgggggttaagttacggcccgttaggggtaacccg

SEQ ID NO: 145820 - DNA, 558 bp, Homo sapiens
  misc_feature: GYAE6OF01AJM9J.21.4.A04.1.454.CMB.1.raw
  modified_base (279)..(279): a, c, t, g, unknown or other
  misc_feature (279)..(279): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
  modified_base (516)..(516): a, c, t, g, unknown or other
  misc_feature (516)..(516): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctggagggtccctgagactctcctgtgcagcctctgcattcaccttcagtnaccacaacatggactgggtccnccaggctccgagggagggctggagtgggcgcgtatacgaaggaaanctaanagttacagtacagaatacggcgcgtntagtgaaaaggagttcaccatctacaagagatgaattacgaaaagtactcacgtagtatctgacaaaagtcgaaacagaccctaaggaaaaacccgaggaaccaccgggaccgttagtattaagttggtagggttaanaaacgaaaagtggtaggatgggtaggtagggtagcgtgtacg

SEQ ID NO: 145821 - DNA, 714 bp, Homo sapiens
  misc_feature: GYAE6OF01A92P0.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagacgccaccctctcctgcagcctccagccagaatactccagagactacctactatacgccgtggtaccagacaggaacgccgtggcccgacggccttacccacggttcctcatcctagtcgtcgtccggtacccacgtacgggccctacgttcggacctacgtaccacgtacgtacggttcgaagggtcggacgtaggttcgggtacgtagggacaggtacctttccaacgttcctactaacgttctaacgtttacggacgtaacgttacggtacggtaacgtaccgtagtaaacgttacggtttacgacgttaacgttcgttaacgttacgttcggtaacctgggtaaccgtaagttacggtaggtaaccgtttcctacgttacgttacggttccgggttaaccggtaccggtaaacgggtaaaccggtaacggggttaaacgtaaacgttaacgggaaacgttacggtacggttaacggtcgttaccgaacctcccgtagttcccgttacgg

SEQ ID NO: 145822 - DNA, 642 bp, Homo sapiens
  misc_feature: GYAE6OF01EY3KG.21.4.A04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (319)..(319): a, c, t, g, unknown or other
  misc_feature (319)..(319): n is a, c, g, or t
  modified_base (329)..(330): a, c, t, g, unknown or other
  misc_feature (329)..(330): n is a, c, g, or t
  modified_base (471)..(471): a, c, t, g, unknown or other
  misc_feature (471)..(471): n is a, c, g, or t
  modified_base (563)..(563): a, c, t, g, unknown or other
  misc_feature (563)..(563): n is a, c, g, or t
tcagtcgtcgctcgcacgaccggtgctcgatttagagtagtgatcaggggagagctgctcagttaggacccagagggaaccatgggaaacccccgacgcagcttctcttcctcctgctactctggctcccaggctcagaaaccaccggagaattgtgtgacgcagtctccaggcacctgtcttgactcgaggggaacncgccaccctntcctgcaggcctccagaccagaactcgtccaggacgtacctactacacgtacgtccgtacggtaccacgacgcgaacggaccgtcggtaccgaccggaccgttacccaacnggttccctcnntctactggcctcgggtacccgaccgacgggcacgtacggtccgacgtacccgtacgacgtacggttacgtacggtcgggtcgtaggtacgggtcgtcggacgacgtacttacctactctctactacgtacgttacgtacgnacgacgtcggcgtccgtacggtaacgtacgtttacgacgtacgttagtacttacgtacgtacgtacgtacgtacgtacgtacggtacgacgnttaccgtaccgtaccgtacggtaccgttacgggtaccgtaacgggtaacggaaaggtaacggtaaacgtaacggtaacg

SEQ ID NO: 145823 - DNA, 781 bp, Homo sapiens
  misc_feature: GYAE6OF01D4YQJ.21.4.A04.1.454.CMB.1.raw
  modified_base (202)..(202): a, c, t, g, unknown or other
  misc_feature (202)..(202): n is a, c, g, or t
  modified_base (768)..(768): a, c, t, g, unknown or other
  misc_feature (768)..(768): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgagggggaaanacgcccacccctctcgcgacacgcctacgacgacgaataactaccacgagactactaacatagtacgtcgtaccgacagacaagaccgtcgacgacgacgtcctacgtaccgttccaactcgttacgtacgtcgtacgggtcccgaacccgtagggaccgtaccttaggaccgacctaccgtaccgagtaaccggtcgtacgtgggcgtacggtagggttcgggtacggtacggaacgtaccgttactaccgttactactactacgttacgtacgtacgaagtacggttaccggtagacgttaccgtaaaggaacgttttcgtaacggtacgtaaccggttttaagtttaacccttcgggttaccaaggttacccggtaaaaggtttcgtttaaaggggaaaaccggttttcctaaccggactttcggttacggggtaacccgtacggaaaaccgggtaaacggtaaccgttaaagggggtaaaaataacccggggtaaacgttaaacccgaggggtttgggaaacccgttcccggaaactaaccccctttaagttcccgggtttnttaaacccccggg

SEQ ID NO: 145824 - DNA, 861 bp, Homo sapiens
  misc_feature: GYAE6OF01A8G4E.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctgagtcttgggttttccttgtttgttattttacgaaggtgtccagtgtgaggtgcagcgtgggtggagtcggtgggggagtacgttcggtccgacggtccggtagggtacgggtccccgttaggaaccgtaccttccgttcccgttggtcggccgtacgtccccttcgtcggtaccttactttcccctaaccctttacgacggtaccgtaacccaaccgtaaaccgtaggttccggggtaaccgttccgggggttaccccgacccgaacgggtcccgtacccgggaaggggggtaaccggggtcggttaggggtaggggttccggggttaccgggtacggtttaaacgttaaaccggaaacgggtaaacgtaccgttaaacgtaacggttaacgaacgttaacgaacgtaaacggtaccgggacgttaccggttacggtagggttaacgggaaaacggggttaccgttacccaaccgttacgttacgtaacgaaaggtaacgtagtacgtaaacgttacaaaacgtcctaactacgtagtacttcgacgtaactaacgtacggaacaccggtaacgtaaaccggaaacggacggtaacccggcggttaacggttacgtttaaagttaggttttacgggaaacggtaaagttaaacgggaaaggtttacggtagggttacgtttggggtaagggttaggttagtacggttgtaaacgg

SEQ ID NO: 145825 - DNA, 760 bp, Homo sapiens
  misc_feature: GYAE6OF01CCNVJ.21.4.A04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggcctcccaggctcaacgaaaccaccggagaaattgtgttgacgcagtctccaggccacctgtctttgctccgaggggaaancgccacctcncctgcagcctccagccaagaattacnccagacgtctaacctanatcgaccgtacggtaaccagacaaggaacgtccgtacggccgaaggtccctacccgtaggttcctacaattctacgtgccgttcggacccagcgggcctacgtcgctacctccgagtaccgtaggtcacgttcggcgtaggttcgggctaggggaactacgtctttaccacgtctactactcgtaagtcgactaacggacttggggaaccgttccgtaagtaacggttaccgttacggtaaccgttagggtttaacgttaacgtttcggacggttaccgtaaggtccgttaacgggttaagttaccgggttaaacggtttccccttaccgtttaaccgggttccgggtttacccgggttacgggaaaccccggtaaacggggttaaaaccgtaaagggttaaaccgtaaaacgggtttaacgggaaaacccggtttacgggtttagggaaaccggtttcgaaaacccgtagtaaaacccgtttcgggttaaccgtttaacccggg

SEQ ID NO: 145826 - DNA, 759 bp, Homo sapiens
  misc_feature: GYAE6OF01CV1MB.21.4.A04.1.454.CMB.1.raw
  modified_base (585)..(585): a, c, t, g, unknown or other
  misc_feature (585)..(585): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggcctccaggctcaagaaacccaccggagaaattgtgttgacgcagtcctccaggccacccttgtctttcgtcctaccgaggggaaacgacgcccaccctctcctgaccagcctaccgagcccaaggaactacgtaccgaggacgacctaacctacagtacgcctaggtaccagcaaggaacgtccgcggacccgacggtcctccccgtacggtttccactacttactacgtcggtaccgtccgggtccccaacgacgggtcccacggtcgggtacctaacgtcccgaaggacgttacggttacgacgggtcggcgtaggggttcgggtacgtacggggaactacggtaccttcgaccgttccgtactacgtacgtagttacggacgtacggtaccgttagggtacctacgttaaggaacgtttacgtttacggacgtttaacggttacgtttaacgtttaccgnggttaacccgaggtaccgtaagggtttacggttcgggtaacctttccgtacgtttccggttacggttaccggttaccgggaaccggtaaacgggtaacctaagggttaacgaaacgttaacgggaaagtaccgttcgggtacgtacctacgaccttaaccgtgtcccgttacgg

SEQ ID NO: 145827 - DNA, 652 bp, Homo sapiens
  misc_feature: GYAE6OF01CIRKE.21.4.A04.1.454.CMB.1.raw
  modified_base (449)..(449): a, c, t, g, unknown or other
  misc_feature (449)..(449): n is a, c, g, or t
  modified_base (627)..(627): a, c, t, g, unknown or other
  misc_feature (627)..(627): n is a, c, g, or t
  modified_base (637)..(637): a, c, t, g, unknown or other
  misc_feature (637)..(637): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcaccctgttctttgtctaccgaaggggaaacgcgccctaccctctcctgcagcctaccacggaccaagaactactccgaagacgacctaactacatacgccgtacggaaccagacaagaacgccgtcggaccacggtccctacccgtacggttcctactacgttactagcggtcccggtacgggtaccccaacggaccgggccctacggtcggaccaacgtccccgaagtaccgtaggttcagggtcggcgtagggttcgggtcgtagggtaacngtacctaccgtaccgtctaacgattactaacgttacgacaaggtccgtaggacgtacgtagagtttacgtcgtacgtggtattcgttacgtcagacgtcgtaagttacggtagtacttacgtactgtacggttacgccggaagtaaccgggaagtaaggtaagaagtaacgaaacggnttagcgtacncgatcctgtcttacg

SEQ ID NO: 145828 - DNA, 755 bp, Homo sapiens
  misc_feature: GYAE6OF01A72HO.21.4.A04.1.454.CMB.1.raw
  modified_base (144)..(144): a, c, t, g, unknown or other
  misc_feature (144)..(144): n is a, c, g, or t
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctccaggctcagaaaccacggnaaattgtgttgacgtcagtctccaggcaccctgtcttgctcgagggaangccacctgtcctgcagctccagcagaatatccagngctacgtacagtacgcctaggtaccagtcagaacgccttggacctaggcctccgaggtttccctacgattccttagcggtacgttccggggtacccaaggaccggggtcctaacggttcgggacctaacgttcccgaagtaccgttacgggtttccaagggttcggccgtaagggttcgggtaacgtacggggtaactaggtacctttcggaacctttccgaacgtacgtactaacgtttacggaccgaagtacgttacggaaaccgtccttaaagggtaacttaccgtttaccggacgttaaggttacgttaactttacgtcgttacgaacgtacttaaggttacggtagggtaaccgtttccgaaccgttcggttaccgggttacccggtttacggggaaccgtaaacggggtaacccgttaaaaggggtaacgtttaaacggtaacgggtaaaaacgttaccggttagggttaaccgggtccttaacgggtaacccgaaacgtttaccgtttacggtttacccg

SEQ ID NO: 145829 - DNA, 920 bp, Homo sapiens
  misc_feature: GYAE6OF01C4OR1.21.4.A04.1.454.CMB.1.raw
tcagtcgtcgctcgcacgaccggtgctcgatttagagtagtgatcagggggagagctgctcagttaggacccagagggaaccatcggaaaccccagcgcagcttctcttcctcctgctactctgacctcccaggctcaacgaaacccaccggaagtaaattgtgttgacgcagtctccaggcctacccttgttcttttgtccgtaccggaagggggaaacgaccgcccctacccctccgtcctcggccacgtcctcccgacgacccgaaagtaactacgtacccgaaggtacgtaccttaacctaacgtaacgttacggtacccgtttacgggtaaacccgacggacgaaacggtaaccggtacccggtacggacccgaccggtaccctacccccggttacggtttccctaaccgtactttaccgtacgttccggtccggttacccggggtaccccgaacggacccgggtaccaacggttccgtaccgtaaccgttaaccccggaagtaaccggttaccggttacgtacgggttcgggacggttacggggttccgggtacggtacggggtaacccgtacggttaaccctttaccgtaccgtttacctaccttacgtacgttaacgttaacggacctagggttaaccccgagggtacctaacgtttaagggaactttccggtttacggacgttagtttaacgtttacggtttcgtagtacgtaacgttacggtaacggtttacgaacggttaacgttccgttacccggtttaggtacgggttaccgggttaaccccgggaaacgggtaaaccgggttaaacgtaaaaggtaacggttaaagttaacccggggttaaagttaccgggttgggttaccgtaaccgttaccggaccgtttaacccgttagtttcccggttaacg

SEQ ID NO: 145830 - DNA, 783 bp, Homo sapiens
  misc_feature: GYAE6OF01DJSYA.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgtctttgtctccgaggggaagacgccaccctctcctgccgagtcctccagcccaagtaactaactccgaagacgcttaacctacatacgccgtgtaaccagacaagaacgcctggccacggtctaccccgtaggttcctcgtactcgtatcgacgttcgggtaccctacggacgggtccgacgtcggccactaccccgagtaccgtacgggttacgacgggtacgggtcgtaacgggttcggggttaccgtaggggtaacgacgttaaccgtttaccgtaacccttctaaccgtactaccgttaattaacggacctaaggtaccggtagggtaaccgttaccgttaaggtaaaccgtttacgtttccggtaccgttaagtttacggttaacgttttaccggtacgttaccggtaacggtaacttacgggttaagttaacgggtttaaccgttaccttacccggttacgtttccgggtttaccggtacccgggtaaacgtaaaccggggggtaaccctaaaaggggttaaacgtaaaacggttaaccgggtaaacggtaacggttagacccgggttataccggaccttaactacgtttcggttaacc

SEQ ID NO: 145831 - DNA, 829 bp, Homo sapiens
  misc_feature: GYAE6OF01A6ISM.21.4.A04.1.454.CMB.1.raw
  modified_base (184)..(184): a, c, t, g, unknown or other
  misc_feature (184)..(184): n is a, c, g, or t
  modified_base (308)..(308): a, c, t, g, unknown or other
  misc_feature (308)..(308): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcacctagtggagtttgggctgagtcttgggttttccttgttagttattttacaaggttntccagtgtggaggtgcagtcgtgggtggagtcggtgggggaactacgtttcggacccgtaggtccgtagggaccgggttcccctggaacggtccttccgtccgtaggtcgcctacggtcccttntcgtactacttccctaaccttcgacgtacgaacctacaacgtgtacggaccggttcggggtcccgacgtcgggccgtaccggaaggggggaacggtccgttaggggtaacgggttcgggtaccggtaccgttaattaaccggaaaggtaactacgtaaacgtacgttaagaacggtaacgaaggtaaacgtccgggtacctcggttactagggtaaacgggtaaaggtaccggttccaacccttagtacctaacgtaagacgtataacgttaactaacgtaaaaccgtacgtactaaccgttagtacgtacgttaacggaaactaaacggttaccgaaccgttaaccggtaaccccggtaaaaggtaaaccccggtaagggtaacccgtacgggttacccgttaaggttaacgttttaaggtaaccgggttaaggggtaaacgtaaaacggtaaaacgggttagggttaacggttagggttaccgggttagggttaacgggacgtaccgggttaggtaacg

SEQ ID NO: 145832 - DNA, 805 bp, Homo sapiens
  misc_feature: GYAE6OF01B5N3S.21.4.A04.1.454.CMB.1.raw
  modified_base (225)..(225): a, c, t, g, unknown or other
  misc_feature (225)..(225): n is a, c, g, or t
  modified_base (508)..(508): a, c, t, g, unknown or other
  misc_feature (508)..(508): n is a, c, g, or t
  modified_base (785)..(785): a, c, t, g, unknown or other
  misc_feature (785)..(785): n is a, c, g, or t
tcagtcgtcgctcgcacgaccggtgctcgatttagagtagtgatcaggggagagctgctcagttaggacccagagggaaccatcggaaaccccagcgcagtcttctcttcctcctgctactctggcctcccgaggtcctcaacgaaaccaccggaagtaaatttggtgttcgacgctagtctccgaggcctacccttgttctttcgtcgtaccgaaggggaaacncgcccaccctctcctgcacgtcctaccagaccaagtaatactaccgaagacgtacctaacctaactaacgtaccgcccttaacgggtacccaaggtaccgaacggaaccgtcccgtacggaccgtaaccggtccccttaccccggtacggtttcccctataaccgtttactacgttcgtacccgggttccggtacccgtaccggtaccggggaaccctaccggtacggaccctccgtaacccggaacgttaccgtacggtttacgacgggtcgggttaacggnggggtttacggggtacgttaacggacgtacgtttaccttaccgtacgttaccctacgtaacttacgtaacgttaccgaacgtaacggtacggtacgggtacgtaccgtaagtaacgttcgttacgacgttaggttactaacgttacttaggtcaacgtacggttagtacgtaggtaccttacgcgtttcgtacggtccggttacgaaccggtaaacggtaaccggtaaacggtaactaaacggtaacggtaaacgtccgtaggtaaccgcgttaccncgtaattaccgtgtttaccg

SEQ ID NO: 145833 - DNA, 911 bp, Homo sapiens
  misc_feature: GYAE6OF01DYV6R.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggctcccaggctcaagaaaccaccggagtaaattgttgtgacgcagtctcagcacctgttcttgtctcgagggaancgcccacctctcctgacgatcctccagccaagtaactacgccaaggactactaactacgatacggcctacggtaccagacaacggaacgtccgtcggacccgtacggtcccttcccgtacggtttcccacttacgttccgttaagtccggtaccggttaccggggtacccaacgggtaccgggaccctaacggtccggtacctacccgtacccgaacggaccttacgggtttaccgagggttcgggtaacgtacgggtttcggggtaccgaacgggggtaactacgtaaaccggttccgttaaccgttcctaacgttacttaccgttaaacggttaacggtaccgtaaaggttacccggggttaacggggtactaacccgggtaacgttaaacgggtttacccgtttttagggaacccgttttaaagggtttaccgttttaacttttaacccgggttaccgttaaccggtaagggtaacccggttttaaaggttaccgggtttaaacgggtaaaccgttttcccgtaaaccccgtttcggggtttaccggtttacccggttaaaccccggggtaaccggaaaaaccgggggttaaacttaaaacggggggttaaaaagttaacccgggaaaacgggttaaacccggtaaaccgggtttacggtaccgggttaacccgtaacgaacccgttccgttaaccgttttaacggttccccg

SEQ ID NO: 145834 - DNA, 725 bp, Homo sapiens
  misc_feature: GYAE6OF01C6BK4.21.4.A04.1.454.CMB.1.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (563)..(563): a, c, t, g, unknown or other
  misc_feature (563)..(563): n is a, c, g, or t
tcagtcgtcgctcgcacgaccggtgctcgatttagagtagtgatcagggggagctctgagagcggagccccagccccagaattcccaggttgttttcatttggtgatcagcactgaacacagaggactcaccagtggaggtttgggctgagtcgttgggttttccttgttgttattttacgaaggtgtccagtgtgaggtgcgagcgtgggtggaggtcggtgggggagtacgttcgggtaccaggcccgttaggggacgggttcccgtaggacgtccttcctccgtgtcgcncgtcctgtcgctacgttcctaacccgttnacggttacaaccacaacgtagtcggacgtcgggtcccnccgaggccgtaccggaaggggtacggggcgtgggagggttcggggtaccggtacgtaagtaacggaaaaggaactactaacgtacgttaacagtaacaagtaacgacggtcgcgttcgtaggaacggaacggtaacgtacaacgtcgtacgtaacgtaaagagtagtacgtaagttaacaaaacgtaactactaagtacgttntacgacgtaaactaagtaacgaacgaaccgtaaccgaaaggaaacccggaacgaccgaacggtcggttaagtacgttaagttaacgggtaacggtaaacggaaacgtaaaagggttgggaaacggtaggttcggtaggttaagggcgttagttcggtaacgg

SEQ ID NO: 145835 - DNA, 728 bp, Homo sapiens
  misc_feature: GYAE6OF01BRC44.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccgtgtctttgtctccgaggggaaancgccaccctctcctgcagcctccacgccaagaaactactccgagagaccttaactaacactacgcctagggtaaccagcgaagaaacggtcctggacccgaaggtcctacccgtacgggtttccctacgtacttcgtagtcggtccgttacggggtaccccaggacgggtcccaacgtcggacctacgtcccgaagaacctaggttcgaacggtggacgaggtcgggtctagggaactacgtaccttctacgttctactagttacgtaagttacgcgaaaggtcgtagggacgtaccgtagtaacgttacgttccgaagttacggttacgtttacgttaacgttcggtacgaacgtcgtaaggttaacgttgggtaaaccgtttactaacccgttcgttcgggtttaccgtaaccgggtaccgtaaacggggtaacccgttaaaagggtaacgtaaaacgtacggtaaaaacgggacgttcgggttaacgtaccgttacgtaacctaacctacgtttccgtaaccgg

SEQ ID NO: 145836 - DNA, 793 bp, Homo sapiens
  misc_feature: GYAE6OF01C51WR.21.4.A04.1.454.CMB.1.raw
  modified_base (199)..(199): a, c, t, g, unknown or other
  misc_feature (199)..(199): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccacggagaaattgtgttgacgcagtctccaggccaccttgtctttgcctcgaggggaacngcccacctcgtcctgcacgctccagccgaagtaatactccagacgcttaactanagtacgccttacggtaaccnggaccaaggaaccgccgtaggggacccaagggtccctaccccgtaggttttccccatacttccgttaagtcggttccgttaccggggttaccccaagggttaccgggcccctaagttccgggacctaaccgttaccccgaaggtaaccgtacggtttccgagggttcgggtccggtaagggtttcgggtacctaggggacccctaggtttaccctttaccgacgttcctttaagaaccttacgtaacgtttaccgactaaggtacgttacgggacgtacccgttaggtaaacgtttacgtttcggtaccgttaggttaaccgtttaccgttaacgtttcggtacgtaacgggtccttaaggttaaccgttagggtaaccgttttaaccgtacccggttacgtttccggttacccggtacccgggtaaccggtaaacgggtaaccgttaaacgggtaactaaaggttaacgtaaaacgtcgttacgggacgtacgtacgaacctacctagttcgttaaccg

SEQ ID NO: 145837 - DNA, 705 bp, Homo sapiens
  misc_feature: GYAE6OF01BBSJ8.21.4.A04.1.454.CMB.1.raw
  modified_base (208)..(208): a, c, t, g, unknown or other
  misc_feature (208)..(208): n is a, c, g, or t
  modified_base (682)..(682): a, c, t, g, unknown or other
  misc_feature (682)..(682): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaattgtgttgacgcagtctccgaggcctaccttgttctttgtcctaccgaaggggaancgaccacccttcgtacctgccagtcctaccacgaccaagtaatactaccgagactctactacgatacgccgtggtaaccacgacaacgaacgtccgtcggaccgtacggtcccgtcccgtaacggttcccactattccgtagttcggtaccggttccggtaccccgaacggtccggggaccctacggcggtaccaccgtccgaagtacgtacggtttcgaagggtcggtacggtacgggttccgggtacggtaccgggaacgtaacgtttacccgttactacccgttcgaaccgttatacgtaacgtaccgtacgtacgacgtacggacgtacgtagtaacgtcgtttcgacgttgttaacttactacgtcgtagacgtcgtaagtaacgttcggtaacgttctacgtacgttcgtaccgtacggaccgtaagtaacgtaaggactaaacggacgtaaccgagttaggaccgtntacggactaacgtcttcggtacc

SEQ ID NO: 145838 - DNA, 705 bp, Homo sapiens
  misc_feature: GYAE6OF01D6PJZ.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccagaatatccagacgctactacatacgcctggtaccagcagaagcctggccaggcctacccgaggtttccctacaacttcttaagtcggtccgttcggggtaccccaacgacggggccccaacggttcgggacctacctccccgaaggaccgtagggtttccagggttcggaccgtagggttcggggtcgtaggggaacctaggtaccgtttaccacttccttacgtaacgttactaagtttacggactaaggaccgttagggacgtaccgttaaggaaacgttacgttttcgacgtaggttacgttacgtttacgtagtccgtaaggccgttaaggttacgtagggttaaactttccgaacccgttcgttacggttccgggttaccggaccggtaaaacgggtacccggtaaagggtaacgtaaagtaacggaaaacgaacgttggacggtactacggaacctaccgtaatcgttaccg

SEQ ID NO: 145839 - DNA, 800 bp, Homo sapiens
  misc_feature: GYAE6OF01EADJO.21.4.A04.1.454.CMB.1.raw
  modified_base (235)..(235): a, c, t, g, unknown or other
  misc_feature (235)..(235): n is a, c, g, or t
  modified_base (750)..(750): a, c, t, g, unknown or other
  misc_feature (750)..(750): n is a, c, g, or t
tcagtcgtcgctcgcacgaccggtgctcgatttagagtagtgatcagggggagagctgctcaggttacggacccaggaagggaaccagtacggaaaccccagcgcagtcttcctcttcctcctgctacctctcggcctcccgaggcctcaacgaaaccgacggaagtaaattggtgttagacgctacgtcctccgacggctaccctgttctttcgtccgtacggaaggggaaacncgaccctacccttctccgtagctacgtcctaccgaacggactaacgtaaaacttacgaccgaagtacgtacttacctaaatacgtacgtacccggtaagtaaccgaacggacgaacgaacgtccgacggaccgacgtccctaccggttacggttccctacgaccttcgtaacgtccggtaccggtccgggtaccaaccgggtaccggaccgacgttacgacccgttaccgtaccggaggtaaccgtacggtacgtcggtagggacgtacggggttacgggtacgtacggggaactaacgggtccttactacctcttaacaacgtactaacgttacgaacgttacgtaacgggttcggaacgttaacgtaaggttaacgttacgttacgtaacgttaagttacgttaacgtttcgttacgagtaactacggtagtaacggtacgtacgttaccgcgtttcgtagggttcccgaaggtaaccgaaagggtaacgtaaacgtaaagttaacgggtaanaaaccggttagtacgggttaactcgaactacccaacgttccgtacgttcg

SEQ ID NO: 145840 - DNA, 702 bp, Homo sapiens
  misc_feature: GYAE6OF01C3R3V.21.4.A04.1.454.CMB.1.raw
  modified_base (316)..(316): a, c, t, g, unknown or other
  misc_feature (316)..(316): n is a, c, g, or t
  modified_base (341)..(341): a, c, t, g, unknown or other
  misc_feature (341)..(341): n is a, c, g, or t
  modified_base (689)..(689): a, c, t, g, unknown or other
  misc_feature (689)..(689): n is a, c, g, or t
tcagtcgtcgctcgcacgaccggtgctcgatttagagtagtgatcaggggagctctgagagcggagccccagccccagaattcccaggttgttttcatttggtgatcagcactagaacacagaggactcacagtggtagtttgggctgagtcgttgggttttccttgttagttattttacgaaggtgtcagtgtgaggtgcagcgtggtggagtcggtgggggatcgttggtccaggccgtagggacgggtccctggacgtacctcgtcctgtcgcacgcctctgactacgttcctaccttcgacgtacgacccanaacgtagtcggacgtcgggtacccncgacggtccgtacggaaggggtagggccgtagggagttcgggacgtacgtaagtacgaaaggaacgtactaaacgagtaacgacgtaacgacgtaacgtacggcgtacgtcgtaagtaacggtaaaggtcgtacaccgtaataccgtagaaacgtatacgtagtaacgttaacaaaggtacttccaagttacgtaatacgtacgtaaactaaaggaccaaccgaagtacccggtaaaaccgaaacggcgtaaaccggcccggttagtagtttaaaccggttagttagggtaaacgtaaagtaaaacgaaagggttccggtaagtaaccggttggtagggtaacgggtnacgttaggtaacg

SEQ ID NO: 145841 - DNA, 559 bp, Homo sapiens
  misc_feature: GYAE6OF01A2WD2.21.4.A04.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (460)..(460): a, c, t, g, unknown or other
  misc_feature (460)..(460): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctggagactctcctgtgcagcctctgcattccaccttcagtcgacccacaacatgggactcgggtccnccaggcctaccgaggggaaggggctgggaggtgggtccggccgtattaacgaaggaanctaaacagttacagtacagaactcggctcgtctggtagaaagggtaggttcaaccatctacaagacgatgaattacaaagtactcactgtatcngacaaatcgaacagacctaagaaaccgagaccacgggtcctagttattagtgtaggtaanaacgaaaggngtaggatgggtggtaggtagcgtggtacg

SEQ ID NO: 145842 - DNA, 764 bp, Homo sapiens
  misc_feature: GYAE6OF01BMC2R.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgcctactctggctcccaggctcaagaaaccaccggagtaaattgtgttgacgcagtctccgaggccaccctgttctttgtctaccgaggggaaagcgccctacccgtctccgtgacacgcctaccgagaccctaagtaaactacgtaccgagacgtacctaactaacgatacggcctacgggtaacccagccgaagaacgccgtacggacccgtagccctacccgtaggttcctacgacttcgtacgtcggtccggttcggtacccctacggaccgggcctacggtggacctacgaccccgtaaggtaccgtacgggttaccgacgggtcggtacgtacggggtacgggttcgtaacggggacctaacgggttaccttccgtaacgttccttacgtactctaagttacgactaggtacgtggaacgtccgtaggtaacgttacgttcgtacgtaggttacgttacgtttacgtgttaccgagtacgtaaggttacgttacgggtaacttaccgttaccgttcgttaccgggttaccgggttaccggtaccggtaaacggggtaaaccgtaaaggtaaaccggtaaagtaacggtaaacgtaccggttacgtaaccggggtactacggaaccgtaccgtacgttcgttaccg

SEQ ID NO: 145843 - DNA, 777 bp, Homo sapiens
  misc_feature: GYAE6OF01EHKWY.21.4.A04.1.454.CMB.1.raw
  modified_base (168)..(168): a, c, t, g, unknown or other
  misc_feature (168)..(168): n is a, c, g, or t
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtcncagcaccctgtctttgtctcgagggaaancgccaccctctcctgcacgctccagcagaatactccagancctaactacatacgccttaggaccagacaagaacgtccgtacggaccgtacggcccttaccccgtacgggtttcccctacgtacttcgttaacgtcggtaccggtttaccggggtccccaaccggtaccggggaccctacggttacgggacctaccgtacccgaacggtaacgttacggttacgacgggtcggtacggtacgggtttcgggtaccggtacggggaacctacgggtacctttaccgaaccgttctacgtacttacgtaactttacggaccgtacggtacgttcgggaacgtccgttaagggtaacgtttacgtttaccggagttaacggtttacggtttaactttaccgtacggtaccgtaacggtaccgttaaggtttaacgttacgggtaaacgtttccttaccggtttacggttaccggttaccgggttaccggtaacgggtaaaccgggtaaacgtaaacgggtaaacgtaaagtacggtaaacggtacggttaggacgggtctacgtacgtactcgtaacgttccg

SEQ ID NO: 145844 - DNA, 724 bp, Homo sapiens
  misc_feature: GYAE6OF01ES9I9.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagtaaattgtgttgacgcagtctccaggccacctgtctttgctaccgagggaanacgccaccctctcctcgcacgcctccagccaagtaatactaccagacgtctactacatacgccgtacggtaccagacgaagaacgtcctcgggaccacggtcctcccgtacggttcctacacttctagtcgtccggttccggtacccacggcggcctacggtcgcctacgtacccgaagtaccgtaggttcgaggtcgacggtaggggtcggtccggtacgggaactacggtacctttacctaccgttctacgtacgttacgtaacgtttacgacgtaacgttacgttacggaacgttaccgtaaggttaacgttcggtttacggacgttacggttacgttacttacgtcgtagtacgtagttaacgtaagttcgggtaactttccgtacgttcgttaccggtccggttaccggtaaccggaaacgggtaaccgtaaggggttaaacgaaacggttaacggaaacccggttacgggtacggtaaccggtaccgtacgtaaccctaaccgttgttcccgtttaacg

SEQ ID NO: 145845 - DNA, 868 bp, Homo sapiens
  misc_feature: GYAE6OF01D47UC.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctcgagggaagcgccaccctctccgtgcacgtcctccacgtccaagtaaactactacccaggtacgtacttaactaccagtaacgcccttacgggttaacccaaggaccgaaacggaaacggtcccgttacggcccgtaacggtcccttaccccggtacggtttccctactacttcgttaacttcggaccgttccggggtaccccaacggacggggcccctacgtccgggacctaccgtacccggaacgtaccggtagggttccgaacgggttcgggacgtaggggttcgggttacgacggggtaactacggtacctttacccaagttcccttacgtactacgtaacgtttacgcgaacggtacgttacgggtactaccggttaaggtaaacgtttcgttaccggtaccgtttaaggtttcgttttaacgtttaccggtacggtaacgtcggttaacgttaaggttaccggtttaacgggtaacccgtttttccgtaacccgttttggttaccccggggttttccggttaacccggggtaaaccccgggtaaaaggggttaaaccccgggttaaaaagggtaaacgggtttaaaacctaaaccggggttaaaaccggttaaccgggttacggacgggttaccgtaacgaccccgtttaaaccgttcgttacggtttacccgg

SEQ ID NO: 145846 - DNA, 776 bp, Homo sapiens
  misc_feature: GYAE6OF01D5ADG.21.4.A04.1.454.CMB.1.raw
tcagtcgtcgctcgcacgaccggtgctcgatttagagtagtgatcaggggagctctgagagcggagccccagccccagaattcccaggttgttttcatttggtgatcagcactagaacacagaggactcaccagtggtagtttgggctgacgtcgttggttttccttgttagttaatttacgaggtgtcagtgtgaggtgcagtcgtgggtggtaggttacggtagggggatacgttcggtaccgacgtccggtgggtaaccggtcccgtaggacgtacttcctccgttggtcaccgtccgtccttcgtacgtacttacttccctacttaccaagtaccgaaccaactaacgaggtacgggtaccgtccgggtaccccgaccggtacggtccggtaccggggaaggggggtacgggtaccggtaggggtacgggttccggggtacgtacggttaaagtaacggaaaaggtaaccgtaataacgtaacgttacgaacggtaaactaggaacggttaccggcgttcgtacggtaggtaacgggtaaaaggacgttaaccacgttacgtactaaggaacgagtactaagtaactaacgaaactacgtacgtacgtacgtacgtacgtaagtaacaagtacgaacgaaccgtaaccggtaaaccgaaccgggtaacggtaaccggtaccggtagtttaagtacgttaggtagggttaaacgaaggtaaacggtaagtagggtacgtagggttagtacgggttaggtactggttaacgacg

SEQ ID NO: 145847 - DNA, 808 bp, Homo sapiens
  misc_feature: GYAE6OF01DZJ8M.21.4.A04.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagagtagtgatcaggggagagctgctcagttaggacccagagggaaccataggaaaccccagcgcagtcttctcttcctcctgtctactctcggcctcccaggctacaacgaaaccgaccggaagtaaattggtgttagaccgcacgttcctaccgacggtcctacccttgttcgtttcgtccgtaccggaagggggaaacgacncccctacccttcgtccgtgcctacgtccgtaccgacgaccaagtaaactactaccgagacgtacctaactacacgtaccgtccgtagtaaccagtacaacggacgtccgacggaccgtacggtaccctaccgtacggtttccactcttacgtagtccgtccggttacccggaccctaacgggaccggtcctacggtcgacctaaccgccctaagacggttacggtcgtagggcgtacggtacggggtcggtacgtacggactaaccgttactaccgttacctacttaacgtcgtaaccgttagttaccgacgttaaggaccgggttacggaacttacggtaaggttaacgttccggttacgttacggttacgtttaacttagttacggtttcggaacacgggttaattacggtaacgttacgttaccttccgttaccgttcggtacggttaacccggacggttaaacgggaaaccggtaaggttaaacggtaaacggaacggtttaaccggaaaggtttacgggtacggtacgtaaccgtttacaccgttaacgttcgttccttaaccgg

SEQ ID NO: 145848 - DNA, 853 bp, Homo sapiens
  misc_feature: GYAE6OF01EOINE.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgcctactctggctcccaggctcagaaaccaccggagaaattgtgttgacgcagtcctccgaggccacccgttgttctttcgtcgtaccgaaggggaaacgtacgcccaccctctccctgccacggtctcccgacgaccaagtaactactaccgagacgtcctaacgtacagtacgccgtacggtaccagtaccgaacggaacgcccgtacgggacccgtacggtccccgttacccccgtaagggttttcccctaacgtacgttccgttaacggttccggacccggtttacccggggtacccccgaaaccgggttacccgggggccccttaaacggggttcgggtacccgtaaccccgttaccccggaacggttaaccggtaacggggtttaccgaaacggggttcgggtacggtacggggtttcggggtaccgttagggaactacggtaccttccgacttccgtacgtaacgttcctaacgttacgacgtaacggtacggtcggaacgtaccgtaagtaaacggttaccgtttacggacgttaaggtttacgtttaaccgttacgttacgtagtaacggtaacgtaacggttacggttaacggttacgttaccctaacggttcgtttaccggtaccggttaccgggaaccgtaaacgggaaccggtaaagggtaaaccgtaaaggtaacgttaaacgacgttacgggtacgtaccgttacgacctacgtgtcgttacccg

SEQ ID NO: 145849 - DNA, 900 bp, Homo sapiens
  misc_feature: GYAE6OF01EMFEE.21.4.A04.1.454.CMB.1.raw
  modified_base (414)..(414): a, c, t, g, unknown or other
  misc_feature (414)..(414): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccatggaggtttgggctgagtcgttgggtttttccttgtttgtttattttacaaggtgtcagtgtggaggtgcagtcgtgggtggaggtcggtgggggacgtacgtttcgggtcccaggccgtgggacggggtcccctggacgacctcttccgtggtcgccacggtccttctgacctacttcctaccttacacggtaccgaaccctaaccaaaccgtaaggtcgggaccggttaccgggggtccccgaccgacgggtccgtacccgggaagggggtaccgggggngtacgggggtagggtcggggtaccgggtaccgttaaagtaaacggaaacgggaaacgtacgtaaacgtaagttaacgaagttacgaaaggtaacgtaccgggcgtacgtacgttaggtaacggtaaaagggtacgttaccgaacctattaccgtaacgtaaaggtaagtacgttaaggtaaacttaaccggaaaacgtaaaccttaccgttaacgttaccgttaacttacccgtaagtaaaccgtaaaagttacccggaaaaccgtaccgtaaaccccggttaaaaccgggaaaaacccggtacgggaaaccccgggtaccggttaacccgggtttaagtttaacgtttttaacgggtttaacggggttaaagggttaaaacgtaaaaacggggtaaaaaacggggttaggggttaaaggggttacgttaacgggggggtttacgggtaaaggggtttaccgggttacggttaacgggtaacccgg

SEQ ID NO: 145850 - DNA, 642 bp, Homo sapiens
  misc_feature: GYAE6OF01A924W.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagctccagccagaatactccagagctactacatagcctggtaccagcagaacgcctggccaggcctccgacggttccctactatctagtcggcgttcgggtaccccagacgggccacgtcggacacgtacccaggtaccgtaggttcaaggtcgacgtaggtcgggtcgtagggactacggtacttcgacctctacacgtactagttacgactaaggacgtagggactccgtaagtaacgttagtttaccgacgttagtacgttacttacgtcgtacaggtacgtaaggttacgtacggttaacgttccgtaccttgtacggtccggttacggaccgtaaacgggaacccgtaaagggtaagtaaacgttaacgggaaaccgtaacgtggtacggtaccgtacgaccgtaaccgtgttccgttaccg

SEQ ID NO: 145851 - DNA, 709 bp, Homo sapiens
  misc_feature: GYAE6OF01ETL3T.21.4.A04.1.454.CMB.1.raw
  modified_base (205)..(205): a, c, t, g, unknown or other
  misc_feature (205)..(205): n is a, c, g, or t
  modified_base (598)..(598): a, c, t, g, unknown or other
  misc_feature (598)..(598): n is a, c, g, or t
  modified_base (626)..(626): a, c, t, g, unknown or other
  misc_feature (626)..(626): n is a, c, g, or t
  modified_base (676)..(676): a, c, t, g, unknown or other
  misc_feature (676)..(676): n is a, c, g, or t
  modified_base (688)..(688): a, c, t, g, unknown or other
  misc_feature (688)..(688): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggcctaccctgttctttgtctccgaaggggaanacgcccaccctctcctgcacgcctccagccaagaatactccagacgtactactacagtacgccgtacggtaaccagtacgaacggaacggtcccgttagggaccccgaacgggtcccctaccccggtaacgggttttccctacgtacttccgttaacgtccggtccggttccggggtaccccaacgggtacgggccctacggttcggaccctacgtaccccgaaggtaccgttacggttacgacgggtcggacgtaggggttcgggtacgtaggggaaccaggttacccttctacccgtctactaactcgtaagttaccgacgaacgtaggtacggtacgacgttaaggtaacgttagtttaccgaccgttaggtttacgttattacgtcgtnagtacgtagtacgtagttactcgtcgtntcgttccggtacgaccggtacggtaacagggtaacaaggtacggaaacgngttggaaccggntacgacaactgttcgttaccg

SEQ ID NO: 145852 - DNA, 864 bp, Homo sapiens
  misc_feature: GYAE6OF01EGTR8.21.4.A04.1.454.CMB.1.raw
tcagtcgtcgctcgcacgaccggtgctcgatttagagtagtgatcgagggggagagctgctacagttaggacccagagggaaccataggaaaccccagcgcagcttcctcttcctcctgtcctactctcggcctcccaggcctcacgaaccgacggagaattgtgttgacgctagtctccacggctacccttgttctttcgtcctaccgaaggggaacgacgccctaccctctccctagccacggtcctacccgaacgacccgtaagaacttacgtacccgaaggtacgtaccttaaccgttacctaagttaccggtcccgttacgggtaacccgacgtaaccgaacggtaaccggtccgttaccgggccctaaccgggtaccctaccccggtacggtttccctactacttaccgttagtccgtccggttccggtacccacggtaccgggccctaccggtcggacctacgtacccgagtaccgtacggtcgaggtcggtacgtaggtcgggtacgtacggaactacgtaccttaccaccgttacctacgtagttaaccgttacgttaccgggacgtaacgtacggttagggtaaccgtacccggttagtaacccgtttacgtttacggtaacttagggttacttttaacgtacccgttagttacccgaagttcccgttaagttaacggtaccggtttaacccgtttacccgtaaccggtttcgggttaccgggtttacccgggtacccggaaacccgggttaaagggaacccggttaaaggtaacgttaaaccgggtacggttaaaccggtaccggtgggttaaccctcggtaaccggtacctacccgttgttccggttaaccc

SEQ ID NO: 145853 - DNA, 727 bp, Homo sapiens
  misc_feature: GYAE6OF01EHFZZ.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgcccaccctctcctgcagcctccagccagaatatccagacgctactacatacgcctaggtaccagacagaacgcctggccaggcctcccgtaggtttcccacatctagtcgtccgtcgggtacccacgacgggccaacgtcggaccacgtcccagacgtaggttccaggtcggcgtagggtcgggtacggtgggaactacggtacctttaccgacgttccgttactacgtactaacgtttacgaccgaacggtaaccgtagggacgtacccgttaaggtaaacgttacgtttaccggtacgtaggtttacgtttacgtttacggttacgtaccgtacgtacgtaaggttaagtaccgggtttaacgttacccgttaccgtttacgttaccgggttccggttacccgggaaccggttaaaccggggtaaacccgtaaaggggtaaaacgtaaacggttaaacggtaaaaccggtaacggtacggtaccgggtacgtaccgaccgtaaccttacgttcgttacccg

SEQ ID NO: 145854 - DNA, 831 bp, Homo sapiens
  misc_feature: GYAE6OF01DFWMH.21.4.A04.1.454.CMB.1.raw
  modified_base (322)..(322): a, c, t, g, unknown or other
  misc_feature (322)..(322): n is a, c, g, or t
  modified_base (803)..(803): a, c, t, g, unknown or other
  misc_feature (803)..(803): n is a, c, g, or t
  modified_base (824)..(824): a, c, t, g, unknown or other
  misc_feature (824)..(824): n is a, c, g, or t
tcagtcgtcgctcgcacgaccggtgctcgatttagagtagtgatcaggggagctctgagagcggagccccagccccagaattcccaggttgttttcatttggtgatcagcactagaacacagaggactcaccagtgggtagtttgggctggagtcgtttgggtttttccttagtttgtttaattttaacgaaggttctccgagtggtaggaggtgcaggtcgttggggtggtaggtcgggtagggggtagtacgtttgggtaccaggtccggtgggtaccgggtccctaggacgtaccttccgtcgtgtcgctcgtcctcgngtactaacttcctacccttacgtaggtacaaccctaagaaaccgtggtcggaaccggtcgggtacccaccggtacggtccgtaaccggggaaggggtaacgggtcgtagggacgggtttccgggtaccggtaactttaaaagaaccggaaaaggtaaccgtaagtaaacccgtaaggttacgaaacgtagaaacggtaacggtaccggtccgtacggttaggtaaagggtaaacgggtaaacggttaccgtaaccacccgtaagttaccgaaaggaagtacgtaagtaacgttaaacgtaaacaaacggtaacttaccgtaagttaacgttacgtacaacgtaaactaaacgtaacggaacgaccgttaaacccgggaaaacggtaaaccggagggaccgtaaccgggttattaaaccgttaaggttaagtaggttaaagggaaacgtaaaaggagggttacgttaagggtaggttaacgngggtttaaagccgttaagggnggtaaac

SEQ ID NO: 145855 - DNA, 733 bp, Homo sapiens
  misc_feature: GYAE6OF01A694Q.21.4.A04.1.454.CMB.1.raw
  modified_base (610)..(610): a, c, t, g, unknown or other
  misc_feature (610)..(610): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttggttttcttgttgttatttacaaggtgtcagtgtgaggtgcagctggtggagtcggtgggggagtacgttcggtccaggcccgtgggtacgggttcccctaggacgtacctcctcctggtcgtccgacgtccctcgtcgcctacttaccctaaccctttcgacggttacgaacccaacaaacctagtcggtaccggtcggggtacccgccgacggtcccgtacggaagggggtaacggggtcgtacgggtagggttcggggtccggtaccgtaagttaaacggaaaaggaaacgaccttaaacgtaagttaacgaacgtaaacgaacgtaacgtaccgggacgtcggttacgtagggtaagggtaaaacgggtacgtttacccaaccgtactaccgtaacgaaagagtaagttaagtaactttaacgaaaacgtactaacctaacttgttaactcgtaanaacgaaatacgaacgtacgaaccgtaaacggaaaccgacgtacggcggtacgttattagttagttaggtacggtaaagaagaaaggtcgtaggtagttaggttggtaggtacgtgtcgtaacg

SEQ ID NO: 145856 - DNA, 799 bp, Homo sapiens
  misc_feature: GYAE6OF01AUGEW.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagcgcccaccctctcctgcacgcctccagccagaactactccagagcctactacatacgcctaggtaccagcagaacgccgtggccaggcctacccgtaggttccctcacttctagtcgtcgttccgggtcccacgacgggtcccacgtcggacctaccgtacccgaaggtaccgtaggttacacgggttgggaccgtaggggttcgggtacgtgggggaacctacggtacctttaccgaccttccgttaccgtaacttaccgtaagtttaaccggtaccgaacggttaacggtcgggtaaccggtaccggtaaggtaaacggtttacgtttacccggacgttaacgggtttacgttaacgttttaccggtcggttaaccgtacggtaacgtttaacggttaacggtttaacggggtaaccgttttacccgttacccgtttacggttaccgggttacccgggttacccgggtaaccgggtaaaccggggtaacccggtaaaaaggggttaaaccgtaaaacggtaaccgggtaaaaccggttacggttacggtacccgggttacgtaccggtaacctacccgtacgtttccgtttaccgg

SEQ ID NO: 145857 - DNA, 845 bp, Homo sapiens
  misc_feature: GYAE6OF01DKQRG.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagctctgagagcggacgccccagccccagaacttcccaggttgttttcagtttggtgatcagcactgaacacagaggactcaccagtggtagtttgggctgagtcgttggttttccttgtttagtttatttacgaggtcgtcaggtgtgaggtgangcgtgggtggaggttcgggtggggactcgttcggtccgacggtccggtgggacggtcctagacggtccttccgtcgttgacgcacgtcccttctcgtacttacttacctaccgttacaggtccaaccaaccgaacgtaggtaccggtaccggtccgggtcccgacgcgggtaccgaccggggtaagggggaacggtcgggtaaggggcggttcgggggtaccggtaaccgttaaggaaacggtaaacggaacgtaaccttaacggtaacgttaagaaacggtaacggaaacggtaacgtacgggaccgtacggttacgtaagggtaacgggtaaacggttaccggtaacctaacgtaaccgttacgaacggtaagaaacgtagttaacggtaaaccttaaacgaaccgttaactaccgttaacgttacgtaacttacgaacgtaacgtaacgttaaccggaacgtaaccgtaaccggtaaaccggaacggaaaccgggttaccggaaccggttacggttaaccgtttaagtttaacggttagggttaacggtaaaagggtaaaacgtaaggggttacgggtaagggtcgtttacggggggtagggttacggtttacgggttacggtaggttaaaccggg

SEQ ID NO: 145858 - DNA, 824 bp, Homo sapiens
  misc_feature: GYAE6OF01D9GHK.21.4.A04.1.454.CMB.1.raw
  modified_base (777)..(777): a, c, t, g, unknown or other
  misc_feature (777)..(777): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggaggtttgggctgagtcgttgggttttccttgtttgtttattttacaaggtgtccagtgtgaggtgcgagcgtggtggaggtcggtgggggagtacgttcggtccgagtccgtagggtacggtcccgtagacgtacttctccgtgtcgcgacgtcctcgtgtcctaacttccctaacctttcgtaacggtaccgaaacccaaccgtaaaccgtacgttacggggtaccggttcggggtaccccggacccggtaacgggtcccggttaacccggggaaggggggaacggggtccggttagggtacgggttcggggtacccgggtaccggttaacgttaaaccggaaaaggtaaaccgtacgtaaaacgtaagttaaccgaaacggttaaacgaaggaaacggtaccgggaccggtacggttacgttagggtaaagggtaaacgggtaacggtttaacccaaccttaacgtacgtaaacggtaaaggagtaacgtagtaaacttaacgaaaacgtactaccgtaattacgtatcgagaactaaagtcgtaaaacgccgtaaccgaaggaaaacccggtggaacccgtacggttaacgttaggttaatttaggttacgggtaaacggaaagtaaaagttaaacgggnggttaacggtagttacgggttagggtaggtacgttcgtaggtaaccg

SEQ ID NO: 145859 - DNA, 707 bp, Homo sapiens
  misc_feature: GYAE6OF01DVTSX.21.4.A04.1.454.CMB.1.raw
  modified_base (491)..(491): a, c, t, g, unknown or other
  misc_feature (491)..(491): n is a, c, g, or t
tcagtcgtcgctcgcacgaccggtgctcgatttagagtagtgatcaggggagctctgagagcggagtttccccagccccagaattcccaggtgttttcatttggtgatcagcactgaacacagaggactcaccatggagtttgggctgagcttgggttttccttgtttgttattttacaaggttgtccagtgtgaggtgcagcgtggtggagtcggtgggggagtacgttggtccagtccgtgggacgggtccctgacgacctctcctgtgcacgcctctgctacttccaccttcagtcgaccaacaacagtcggtacgtcggggtccgaccgacggccgtaccggaaggggacggggcgtgggaggtcgggtcgggccgttaagtaacgaaaggaaacgtactaacgtacgttaacaaggtacgaagaacgtaccggtcgacggtcgtaggtaaggaaacggggtacgtttccaaccgtagtaccgttanaacggtataagttagaactttaacgaaaacgtaccttcgactttaggttactacggtaacgtactaaaacgtcggaaactaccgggtacctaaaaggaaacccgggtaggaccgaccgggttaacgttagttagttaggttacgggtaaggtaaacgtaaaggtaaaggtaggtaggtaggttgggttaaggtgttaaacggcgtttggtaaccgg

SEQ ID NO: 145860 - DNA, 682 bp, Homo sapiens
  misc_feature: GYAE6OF01BBRFG.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaaggcaccctgtctttgctccaggggaaagcgccaccctctcctgcagcctccagccaagaatactccagacgcttactaacatacgtccgtggtaaccagcaaggaacgcctggccaggcctccccgaggttcctcatctagtgcgtcgggtcccagacgggccacgtggcacgtacccgaagtacgtacggtcgaagtcggacgtaagggttggggtcctaggggaacctaggttaccctttacgtaaccgttcctacgtaacgttacgtaactttacgaaccgtaacggtacgttcgggaaccgttaccgtaaggtaacgttacgtttcgacgtaggttagttacgttacgtacgtacgtagacgttaagtagtacggttaacgttccctacgttcggttacgttccgtacggtaccgaaagggtaacccggttaaaggtaaacgtaaacggtaacggtaaaccgtacgttggtacggtacgtacggaacctaccgtacgttcgttaccg

SEQ ID NO: 145861 - DNA, 812 bp, Homo sapiens
  misc_feature: GYAE6OF01DW5L8.21.4.A04.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcaacgaaaccaccggagaaattgtgttgacgcagtctccgaggccacccttgttctttcgtctaccgaaggggaacnctacccaccctctcctcgcagcctccacgaccaagtaactactaccagacgtacttaactacagtacgccgtacggaccagacaagaaccgccgtacggaccgacggtccttaccccgtacggttccctactacttacgttacgtcggtccggttaccgggtaccccaacggtaccgggccctacgtcggtaccaccgtacccgaaggtacgtacggttacgaggtcggaccgtaggggtcggtacggtacgggacctacgggtacctttccgactttacctactacttacgtacgttacgacgtagtaccggtgacggtacgttaaggtaacgttacgtttacggacgtttagttacgtttacgtttacgtacgttacgtaacgtacgttaaggttacggtaacggtttacgttccgttaccgtttcggttaccgggtttaccggttacccggggtaaaccgggtaaaccgggttaaaccgggtaaaacgggttaaacggtaaaacggttaaccggtaaaaacgggtttacggttacggggttaaacgttaaccggtaacggttaaccctaaaccgtttaccgtttcggtttaacccgg

SEQ ID NO: 145862 - DNA, 898 bp, Homo sapiens
  misc_feature: GYAE6OF01C0A7R.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatgggtagtttgggctgagtcgttgggttttccttgttgttattttacaggtgtcagtgtgaggtgcgagcgtgggtggaggtcggtagggggatacgttggtccaggccgtgggacgggttccctagacgtaccttcctccgtgtcgcacgtcctctgctacttcctaccttcgacgtacgaaccaacaacgagtcgggaccgttcggggtcccgaccgcggtccgtaccgggaagggggaacggggtcgtagggtagggtcggggtaccggtaccggttaagttaaaccggaaggtaaaacgtacgttaaaacggtagtttaaccgaagttaaccgaaggtaaacgtaccgggtacggtccggttacgttagggtaagggtaaacgggtaaacggtttacccaacccgttaacgttaccgtaaacgtaaagggtaagttaaacgttaacgggtaacttaaccgtaaaacggtaaaccctttaaccgtaaacgtttacggtttaacttaccgttaaaccggtaacttaaaagtaaccggtaaaccgtaacgggtaaccccggttaaaacgggaaaaaccccgggtaaccgggtaacccggtaacccggggttaacccgttttaagggttaaacttttagggttaacggggttaaaggggtaaaaccggttaaaaccgggtaaaaaaggggtacgggggtttaaaggtaagggtttacggggttaaggggttacgggttaaacgggttcgtttaacgggttaaaccgg

SEQ ID NO: 145863 - DNA, 882 bp, Homo sapiens
  misc_feature: GYAE6OF01AUJXU.21.4.A04.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (257)..(257): a, c, t, g, unknown or other
  misc_feature (257)..(257): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaaccacgganaaattgtgttgacgcagtctccaggcaccctgtctttgtctccgaggggaaancgccaccctctcctgcacanccagtcagtctatcgctgactggttacnccgtagtacngacacgaattctaggccaggcctccgaggtcctcctctacttttaccgcgcactccgacgacggccacgtcggtctccgacgtacgtggttacaggttcggcggttggtacgtttgggaactacggttacggttttctaccgtctaaccctacgttccgaccggtacccgtaccccgttaacggtaacggtacggttaacggtaaacgggttacgtttacgggtttacggttacgtttaaaccggttttttaaacttttccggttaccggtaacccgttaaggtaaccccgtttaaaagtttaaaccgttttaaaacgttttaaccccgggtttacggggttaccccgttttaccgggtacccgggtttaaccgggttacccggggttttaaccgggacccgggttaaaaccccgggggtaacccgtaaaccgggggttaaacgtaaaacccgggttaaaccgtaaaaacccgggttaaaccgttaccggggtttaacccgggtaccgttaaccccggggtaacccgttaaaaccccggttaaccgtttaccccgggttttaacggtttaccccggtttttaacccgttaaaccccggttttcccccccgtttaaaccccccggg

SEQ ID NO: 145864 - DNA, 703 bp, Homo sapiens
  misc_feature: GYAE6OF01BQOB4.21.4.A04.1.454.CMB.1.raw
  modified_base (211)..(211): a, c, t, g, unknown or other
  misc_feature (211)..(211): n is a, c, g, or t
  modified_base (351)..(351): a, c, t, g, unknown or other
  misc_feature (351)..(351): n is a, c, g, or t
  modified_base (679)..(679): a, c, t, g, unknown or other
  misc_feature (679)..(679): n is a, c, g, or t
  modified_base (694)..(694): a, c, t, g, unknown or other
  misc_feature (694)..(694): n is a, c, g, or t
tcagtcgtcgctcgcacgaccggtgctcgatttagagtagtgatcaggggagagctgctcagttaggacccagagggaaccatggaaaccccagcgcagcccttctcttcctcctgctactctggctcccagctcaagaaaccacggagtaattgtgttgacgctagttcaccaggcctacccttgttctttgctaccggaaggggaaacncgccctacctctcctgccacgcctaccgacgacctaagaacttcacccgagactacctaactaacgacgtaccggtccgttacggaaccagaccaaggaacgtcccgtaggacctacgggcccttaccgtacggtttccncgttaactccttagtcggtaccgttccgggacccaggtaacgggtccccagtcggcctaacctcccgaagtcgtacggttcaggtcggacggtagggttcgggtacgtaggacctagtaccttcgtaacctcgtacattcgtattacgatacgtacgtacgacttacggtagtaacgttcgtttaacggcgtaaggtttattaaccgttctaggtacacgtagtaagttacggtagtacctttcgacctttggccgggtttccgaccgggtaaacgtaaccggaacggttaaaggtaacgaacgtaacggaacgttacgtgggacctnacccgtaactacgtntacggtttc

SEQ ID NO: 145865 - DNA, 975 bp, Homo sapiens
  misc_feature: GYAE6OF01D5ETJ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagtcgttgggttttccttgtttgtttattttacaaggtgtccagttgtgaggtgcagtcgtgggtggaggtcggtgggggagtacgttcggtccacggtccgtagggacgggttcccctaggacgtaccttccgttccgtggtacgcctacggtcccttccgtcggacctaccttttccctaaccctttacgacgttaccgaaccctaaaccgtaaacgtacggtacggggtaacccggttccgggggtccccgacccgacgggtacccgtaccggaagggggaacggggtcgtaggggtacggtcggggtccggtaccgttaagttaaccgaaaggtaaacgtaccgtaaaacgtacgtttaaccgaaggttaaacgaacggtaacggtacccgggtaccgttaccggttacggttaagggtaaacgggtaaacggggtaaccggtttacccaaccgttaacgttaccgttaaagaaacggtagtaacgttaaggtaaacctttaaacggaaaaacgtaaccccgtttacgtaaaccgtttaggtaaccttcgtttaaacgaaacgtaaaacgttacgaaaccgtaacccgttaaccggtaaaacggaaaaacccccgggtacgggaaaccccggttacccggggttacccgtttttaaaacgggtttaagtttttaaacgggttaccggggtttaaaaaggggttaaaaccctaaaaaaccgggtaaaaagggggttaaacggggtttaaggggttaaaccggtttaaggggggtttacgggtttaaaggggttaccgggttaacccgtttaagggggttaaaccccgg

SEQ ID NO: 145866 - DNA, 910 bp, Homo sapiens
  misc_feature: GYAE6OF01D2QJX.21.4.A04.1.454.CMB.1.raw
  modified_base (770)..(770): a, c, t, g, unknown or other
  misc_feature (770)..(770): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttggctgagtcgttgggttttccttgttgttattttacgaaggtgtccagtgtgaggtgcgagcgtggtggagtcggtagggggagtacgttcggtaccgtacggtccgtgggtaccgggtcccgtaggtacgtaccttccgtccgtgtacgccgagtcccttcgttacggccttaaccgtttccgtaacccgtttacgaacgttaccggaaacccctaacctaaaccgtaacggttaccgggtaacccggttccggggggttacccccgaccccgtacggggtaccccggttaaccgggaaacgggggggaaccggggttccgggttaacgggggttacgggggttaccggggggttaacccccggttaacccgggttttaaaacggtttaaaaaccggggaaaagggtaaaaaccccggtttacccgttaaaaaccgggttaaccgtttaaacccggtaaacggttaaaccgtaaacggtaaacgggtaccccgggtacggttaccggttacggttaacgggtaaagggaaaacggggttaaccgtttcccgaaacctacgttacctaaacggtaaggtaacgagttacgtaacgttaaccgaaaacgtctaacgtacttagtactgtanaacgtagtaacgaacgaccgtagaaaccggtaaccgacggaaccgtccggtagttattacgttagttacggtaacggtaagtaaacgaagggttaccgaggttacgtaggttacgggtggtaaacgtcgggttagtaccg

SEQ ID NO: 145867 - DNA, 710 bp, Homo sapiens
  misc_feature: GYAE6OF01C9EFV.21.4.A04.1.454.CMB.1.raw
  modified_base (360)..(360): a, c, t, g, unknown or other
  misc_feature (360)..(360): n is a, c, g, or t
  modified_base (660)..(660): a, c, t, g, unknown or other
  misc_feature (660)..(660): n is a, c, g, or t
tcagtcgtcgctcgcacgaccggtgctcgatttagagtagtgatcaggggagagctgctcagttaggacccagagggaaccatcggaaaccccagcgcagcttctcttcctcctgctactctcggcctcccaggctacaacgaaacccaccggaagaaattggttgttcgacgcacgtctccgacggcctacccttgttctttcgccgtaccggaaggggaaacactcccaccctctccgtgccacgtcctaccgacgacctaagaactacaccgaaggactcctaactaacgagttacgccgttacggaacccgagacgaagaacgccgtcggaccgacggccctccgtaacggttccnctatcgtagtcgccgtcggtaccaacggacgggtcccacgtcggacctaccgtcccgaagtacgtacggttaccgaggtcggagtcgggttacgggtcgtacgggactacgttaccgtacgtacttacgctaacgtactacggttacgacgtaacgtacggacggtactacgtacgtaacgtcgtttacgacgttaggttacttacgtcgtagcgagttacgaacgttagtacgttacgtaccgtacgttcgtacggtaccgtacggaccgtaaacgggtaaccttaaaggaacggtaanaacggtaacggtacgttaagggactcgactaccgaacttcgttacgtacg

SEQ ID NO: 145868 - DNA, 847 bp, Homo sapiens
  misc_feature: GYAE6OF01BBT2Y.21.4.A04.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccacccttgttctttgtcctaccgaaggggaaacncgcccaccctctcctgcagcctaccagccaagaactacgtccaagacgtactaacctacatacggcccgttacgggtaacctaacggaccgaacggtaacggtacccgtcgggacccgtaacggtccccgttaccccggtaacggtttcccctaacgtacttaccgttaacgtccgggtacccggtttacccgggaccccgaaccgggtaccggggtaccccgtaacggttcgggaaacccttaccccgttaccccgaaaggtaaccggttaacgggtttaccgaggggtaccggtaccgggtaacggggtttccgggggttaccgtacggggaaccctaacggttcccgtttaaccacccgtttcctacgtaacgttaccgtaagttaccggacgtaacggtaccgggtaggaccgtaccggttaagtaaacggttccgtttacgacgttaagtttacgtttaccgttagttcgtaacgacgtacgtaacggtttagtacggttaaccgtttacctaccgttaggttcggtacccggttaccggaaccgggtaaaggtaaccggtaaaggtaaacggtaaacgttaacgggaaacgttacgttgggtaccgacgttaccgacctacgtcgttcggttcc

SEQ ID NO: 145869 - DNA, 914 bp, Homo sapiens
  misc_feature: GYAE6OF01B914V.21.4.A04.1.454.CMB.1.raw
tcagtcgtcgctcgcacgaccggtgctcgatttagagtagtgatcaggggagagctgctcagttaggacccagagggaaccatgggaaaccccagcgcagcttctcttcctcctgctactctggctcccaggctcgaacgaaaccaccggagaaattgtgttcgacgcagtcctccaggcctaccctgtctttgtctccggaaggggaaacgcgcccaccctctcctgcagtcctaccgagacccaagtaactactacccgaagtacgaccttaacactaagttaccggtcccgttacggtaacccgacggaccgaacggaaccggtcccgtacgggacccgtaacgggtccccttaccccggtaacgggtttcccctacgtaacgtttcccttaacgtccggtaccggttacccgggtaccccaacggtaccggggtacccctaccggttacgggaccctaacctaccccgaacggtaccgtacggttaccgaggttcgggcgtacgggtcgggttacggtacggtactacgtaccttacaactttccgtacttactacgttacgttaacggaccgtaacggtaccgttacgggaaccgttaccgttaaagggtaaccgtttaccgtttaccggtaacgttaagggtttaaccgtttaacgttttaccggttacggttaacccgtaacggtaaccgttaacggtttaccggtaacgggtttaacgttacccgttaaccgtttaccgggtttaccggttacccggggttaacccgggtaaaccgggtaaaccggggtaaaccgttaaaggggttaaacccggtaaaagggttaaacccggtaaaacgggttacccggttagggttaaccggtaccgtaccgtaaccgtaaccgttacggttccgttttacccgg

SEQ ID NO: 145870 - DNA, 645 bp, Homo sapiens
  misc_feature: GYAE6OF01C3WS8.21.4.A04.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccaagactanccagancctaacacagtacgcctcggtaaccagcagaacgtcctggccaggtcctaccccgaggtttcctcattacctatgccgtcgggtcccaggacgggccactggccacgtcccagacctggttcagtggcaggtcggtcgcggaacacggtacttcacgttctactatactattacgactagtacgtggtacgaccgtagaagtctttacggacttagtgttaatttacgtcgtacgtacgtaacgtaggtaagttacgggttaacgttcctacgtttacgttacggttacccggttaaccggaacccgggtaaacggggtaaacccgtaagggttaaacggtaaagttacggtaaaacggtaccggttaggtcggtactacggtaccaacctagttcgttaaccg

SEQ ID NO: 145871 - DNA, 795 bp, Homo sapiens
  misc_feature: GYAE6OF01A30DH.21.4.A04.1.454.CMB.1.raw
  modified_base (148)..(148): a, c, t, g, unknown or other
  misc_feature (148)..(148): n is a, c, g, or t
  modified_base (205)..(205): a, c, t, g, unknown or other
  misc_feature (205)..(205): n is a, c, g, or t
  modified_base (437)..(437): a, c, t, g, unknown or other
  misc_feature (437)..(437): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaattgtgttgacgcagtcctcaggccacccttgttctttcgtctccgaaggggaaanactcccaccctctccgtgacacgtcctccgacgaccaagtaaactacgtccaaggacgtcttaacctaactacgttacgccgttacggtaaccaggaccaaaggaaccgtccgacggacctacgggtccctaccccgtaggtttcccactacttcttaacgtcgtccggtacgggtacccacggacggccacgtcggcctactacccgaagtacgtacggtcagggtacggntaaggggtcggttacgacgggtaactacggtactttaccaacgttcctacgtaacttaccgtaaggtttacgaacgtaacggtacgttaacgggaccgttacggttaaggtaacttaaccggtttcgaaagttaccggtttagtttaaaccttccggttaataccggtaagtaccgttaaggttaaccggttaacgttaacggtttacctacggttcggttaccggttacccgggtaccgtaaaccgggtaaaacgggttaacgtaaaacggggtaaagtaaaccggttaacggtaaaaccggtagtttacggggaccttacggacgttaacccgaacgttacgttccggtttaaccg

SEQ ID NO: 145872 - DNA, 757 bp, Homo sapiens
  misc_feature: GYAE6OF01EHLF4.21.4.A04.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (735)..(735): a, c, t, g, unknown or other
  misc_feature (735)..(735): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctgctcccaggctcagaaccaccggagaattgtagttgacgcagtctcgagcacctgttcttgtctcgagggaancgcctacctctctgacncgcctcgagaccagaactactaccgagacgtactaactactagtaccggtaccttacgggaacccaaggaccgaaacggtaaccgtcccgttacggaacccgtacgttaccccgtaccccgttaccggtttaccccttactacctttaccgttacgtccggttacccggttcccgggtaaccccacgggacgggtaccccagtccggacctaccgtacccgaactaccggtacgttacgaacggtggaccggttacggtccgggttaacgacgggtaacgttaccggtaacctttcaccggtttactacggttaacttacgtaacgtttacgacggtacgtacgtaccggcgtaaccgttagaacggtttacgttcgagtttaagtcgttaatttcgtatcgtaacgtagttacggtaggtacgtttaacctaccgttcgtacggttaccgttccgggttaaccgacggtaaacgtaacgtaaaggtaaacgaacacgggttaaacacggttagtacggtaccnctaaccgacgttgtacgttccg

SEQ ID NO: 145873 - DNA, 774 bp, Homo sapiens
  misc_feature: GYAE6OF01B9QMU.21.4.A04.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgttctttgtctccgagggggaaacgcgcccaccctctcctgccacgctccgacgccaagaactactcccgaggaacgtcctaacgtanacgttacggcccttacgggtaacccaaggaccgaaggaaccgggtcccgttcgggggccccggggtcctaccccggtaacggttcccctacgtacttccgtagtcggtccgtaccggggtccccaacggtcgggaccccttacggtcgggacctaaccgttaccccggacggtaaccgtcggggtttcgaaggggttcggacgtaacggggttggggtaccgtacggggaacctacggtacctttacccgactttcctacgtacttacgtattacgacctaaggtaccgtgaaccgtcgtaagtaagtacgtttcgacgtacggttattacttacgtagtccgaggtacgtaattacggtacggttacttcgtaccgtttcggtacggttcccggttaacggggtacccgaaacggggtaacgtaaacgggttaaagaaacggttaacgggaaaacttcggtaacgggtggacctacgacccgtaactccgttcgttccgtttccg

SEQ ID NO: 145874 - DNA, 637 bp, Homo sapiens
  misc_feature: GYAE6OF01CEGHW.21.4.A04.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcagaaaccaccggagtaaattgtgttgacgcagtctccaggcacctgtctttgctccgagggaaagcgccacctctcctgcagctcagccanaatatccagcgactactacatacgcctggaccagcagaacgccgtggaccgacggcctaccccgaggtttccctacgattccgtatcgacgtccgggtacccacgacgggccctaacgtcggaccctactacccgaagtaccgtggttaccgagggttggcctaagggtcgggtccagggacctaacgtaccttctccgttactcgaacttacgtaattacggactaggaccgtaggtacgtaccgtaggtaacgtactttcggacgtacggtagtttacttacgtgtccgaagtactagtacgtacgtaagttcctacgtcgtacgtcgtccggaacgtaacggaacgtaaacgtaagaaacgtaacggtaaacgacgttacggagttccgacgacctctcgttcgtacg

SEQ ID NO: 145875 - DNA, 781 bp, Homo sapiens
  misc_feature: GYAE6OF01CUE7O.21.4.A04.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctccaggctcagaaaccaccggagaaattgtgttgacgcagtctccaggccaccctgtctttgctccgaaggggaagcgccaccctntcctgcagcctccagccaagactactccagacgtacctaactacagtacgaccgtaggtaacccagacaacggtaacgcccgtacggacccaacgggtccttccccgtaacggtttccctactaacgttctacgttcggtaccgttccggggtaccccaacggtaccggggaccctaacggtcggacccaaccgttcccgaaggtaccgttacggtttacgacgggttcgggaccgtaggggttcgggttaccgaggggtaacctacgggttaccctttacgtaacccgtttctacctaacgttaaccgtaagtttaaccggaccgttaacgtaccggttacgggtacgtaccgttaacgggaaagtttacgtttacggacgttaaggttacgtttaacgtttacgttcgttacgtacggtaacgttaaggtacgttaggtaacgtttcctaaccgtttcgtacggttaccggtacccggtaacgtaaacggggtaacctaaagggtaaacgtaaagtacggaaaccgtaacgttcggtacggacttacgacctaactcgttccgttacg

SEQ ID NO: 145876 - DNA, 861 bp, Homo sapiens
  misc_feature: GYAE6OF01D4XAS.21.4.A04.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgttctttgtcctccgaaggggaaanacgccaccctctccngcagcctccagccagaatagtccaganctactacatacgtcctaggtaaccagacctaagaaccgccgtacgggacccgtaacggcccttaccccgtagggtttacccctactaacgtccttaagtcggtaccgttacccggggtaccccaacggaccggggtacccaacggttacgggaccctaaccgttaccccgaacggtaaccgtacgggtttaccagggtacgggtcgtaagggttcgggttacgggtagggaactaacggtacctttcgaacttcctacgtaactacgtaacgttacgacgaagtaccgtagggtaacgtaccgtaaggaacgtttaacgtttccggacgttaaacggttacgtttaacgtttaaccgttacgtaacgtaaggtaaccgtaaggttaacggttacggggttaaacctttacccgttaccgttaccgttcgggttacccgggttaccgggtaaacccgggtaaaaacgggtaaacccggttaaaaggggttaaaaccggtaaaaagtttaaacccggggtaaaaaacccggttaaacggtttcccggggaaaacggggttacccttaaccgggtaaaccccttaaacccccggttattacccggttttaaaccccgg

SEQ ID NO: 145877 - DNA, 875 bp, Homo sapiens
  misc_feature: GYAE6OF01DJLCR.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggcctcccaggctacaacgaaaccgaccggagtaattgtgttacgacgcagtcctccgaggcctacccgttgttcctttcgtccgtaccggaagggggaaacgccgtacccctaccccttcctccgtcggtaccacggccctaccgaacggcccaaagtaactttacctaccgaacggtaacgtccttaaaccgtactacgtaacggtacccgttacggaaccacggaccgtaacggaacggtcccgtacgggaccgaccggttccctaccccggtaccggtttaccctacgtacgttacgttacgtaccgtccggttaccgggtacccgaccgggaccgggtacccaccggccggttaccaaccgtaacccggtaagtaccggttacgggttaccgtaagggttccggtaccgggttagggtttcgggtaccggtacgggtaacgtaccgtttacgttacccgtaactccttacgttactaccgttaagtacgacggtaacgtaccggtacgggtaccgttaacggtaacggttaagtaccgtttaccggtagttaacggtttacgttacgtttacgtaggtcgtacggtactaacggttacggttacgttaacttacccgtaccgtttcggttacgggttaccggtaccggtaacgtaaccggggttaacgtaaaggttacggtaaacgtaacggtaaccggtacggttcggtacgttaccgacgttaacccgactttacgtgtttacccgg

SEQ ID NO: 145878 - DNA, 725 bp, Homo sapiens
  misc_feature: GYAE6OF01EMVRU.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagacgccaccctctcctgcagcctccacgccagaatactccgagagccttactaacatacgccgtacggtaccagcaagaacgcctacggccgacggcctcccgtacggtttccctacgtacttacttagtcggtaccgttccgggtaccccacggaccgggtaccctacgtcggacctacgtaccccgaagtaccggttacggttacgtaacggttcgggtacgtacgggttcggggttaccggtacgggaacgtaacggttaccttccgtaaccttcgtactacgttactaagttacgcgtaacggtacgtggacgtacggtagaacgttactttacggacgttacgttagttactttacgtacgtacgtagacgtaaggttacgtacgggttaacttaccgtaccttcggttacggttcggtaccggaacggaacgggtaaacgaaagggttaacgtaaaaggttacggtaaaaccggtcgtaaggtaccggtactacgtaacctaccttacgttacgttaccg

SEQ ID NO: 145879 - DNA, 802 bp, Homo sapiens
  misc_feature: GYAE6OF01EMIY9.21.4.A04.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggcctcaacgaaaccgaccgggaagtaaatttggtgttagacgcagtctccaggccacccttgttctttgtctacgaaggggaaancgccacccttctcctgcacgcctaccgacgccaagtaatactaccagacgtcctaacgtaactacttacggtccgtacggtaaccaggacaaggaacgccgtacggacccgacgggtccccttaccccgtacggttttaccctacgtaacttcgttaacgttcgggcccggttaccggggtacccaacgggaccgggcctacgtcggacctaacctacccgaaggtacgtacggttcgaacggtcgggtacgtagggttcggggtacgtacgggaactcgttacttccgacttcgtaactacgttactaacgttacgaccgtaaggtacggtaggaaccgttacgtaacgttaaacggtttccggtttaccgtaggttaacggtttaatttaccggttacgtttacgtaaccggtaacggtagtttaaacggttaggttaacgggttaccctttaccgttacccgtttgggttaccgggtttacccgggtacccgggaaaccggtaaaccggggtaacgtaaacgggtaaactaaacggtaacgggaacgttacggtggtaccgtacacgactacgtcttcggttac

SEQ ID NO: 145880 - DNA, 661 bp, Homo sapiens
  misc_feature: GYAE6OF01C3BYP.21.4.A04.1.454.CMB.1.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (651)..(651): a, c, t, g, unknown or other
  misc_feature (651)..(651): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcacccatggtagtttggctgagtcgttgggttttccttgtttgttattttacgaggtgtccagtgtgaggtgcagcgtggtggacgtcggtggggatcgttggtccagccgtggacggtccngacgctctctgncacgcctctgctcttccactcagtcgaccacacgtagtcggaccgtcgggtcccgaccgcggtaccgtacggaggggtacgggtgtagggtacggtcgggtccgtacgtagtaaccggaaggaacgtacgtaaactagttaacaggtaacaaggtaacgtccggcgtacgtacgtaggtaacgggtaaacggtacggttcccaacggtaacctgtaaacgaaggtaagtactaggttaactaaacgaacgtactacctagttactacttagaacgtaacaaacgacgtaaaccgcgtaaccgaaacggtaaccgcgtacgtacggtcgtagttacgtttaggtggtaacgaagaaacggtaagtgtaggacgtgggttacggagtttacgngttggaaacg

SEQ ID NO: 145881 - DNA, 905 bp, Homo sapiens
  misc_feature: GYAE6OF01EG9UH.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgttattttacaaggttgtcagtgtgaggtgcagctgggtggagtcggtgggggagtacgttcgggtccacggtccgtgggtaccggggtccctggacgtaccttcctccgtggtcgcgtacgtcccttcgtcgacctactttacctaaccctttcgaacgttaccgaacccgtaaacctaaacgttaacggttaccggggtaaccggttccggggggttaccccgacccggtaacggggtacccggttaccccggggaaagggggggtaaacgggggtcgttaggggggaacggggtttcggggggttacccggtacccggtttaaaacggttaaaccggaaaaggggtaaacgtaaacccttaaaacgtaacggtttaaaccaaacgggttaaacgtaaacggtaaacggttacccgggggaccgtttaccggttacggtaacgggttaaacgggtaaaacgggttaaccggtttaaccgaaccccttaaacggtttcctaaaaccggtaaaaggtaacggtaagttaacgttaaacgttaacgtaaaaacgttacctaacgtaaccgttacgttaacttaacggtaacaactaaaggtaacgtaaaccaccggtaaacgtaaccggaaaacggtacggaacccgtacggtacgtttacgtagtttaacggtggtaaacggtaagaaaacggtaaggtaggttagaaggttcggtagggttgtacggtgtaggtaacg

SEQ ID NO: 145882 - DNA, 707 bp, Homo sapiens
  misc_feature: GYAE6OF01AUY3W.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccacctctcctgcagctccagccagaatatccagagcctactacatacgcctggtaaccagcaagaaaggccctaggacccaagggcctacccgtaacggtttccctacacgttctaactcgcgttcggggtcccaacgacgggccacgtcggctaactcccaagacgtaggttaccaggtcggacagggttcgggtacgtaggggacaacgtacgtttcaccttctactaactacgtaattacgacgaagtacgttacgggacgtaccgttaaggtaaagtacgtttacggtaccgtaaggtttacgttaactttacgtcgttaacgacgtaacgtaaaggttaacgttaacggtaacggtttcctaaccgtttcgttacggtttccggtaacccgggtaacgaaacggggtacgtaaaacgggaaacgtaaaaggtaacggtaaaaccggtaacgttagggttacggtacgttacggaaccctaaccgtagttcgtttaccg

SEQ ID NO: 145883 - DNA, 729 bp, Homo sapiens
  misc_feature: GYAE6OF01DFKAJ.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggaagaaattgtgttgacgcagtctcaggcacctgtcttgtctcgaagggaancgcctaccctcgtcctgcacgctaccgagccaagtaattacaccgagacgactaacctacatacgccgtacggtaaccagacaagaacgccgtcggaccacggcctcccgtacggttccctacgtacttctagtcgccggttccgggaccctacgacgggccacgtcggaccaccgtcccaacggtacgtacggttacgacgggttcgacggtagggtcgggtccggtagggaccgtacggtaccctttcgaccttcgtactacgtacgtaacgttacgtacgacggtaacggtggtaaccgtacgtaacggtaagttacgttacggtacgttaacggttacgtttaacgttacgtcgtacgtacggtaacgtaagttacgtaacggtaaccgttaccgtaccgttcgttaccggttaccggttaaccgggtaaccggtaaacgggtaaaccgtaaacgggttaaacggtaaaaggttaacggtaaacggtaacgttggtacgtacgtacgacctacctagttcgttaccg

SEQ ID NO: 145884 - DNA, 750 bp, Homo sapiens
  misc_feature: GYAE6OF01B3H1H.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccaggcctaccctgttctttgtcctaccgaaggggaaacgacgcccacccgtcctccgtgccagcctccgacgccaagactactccgaagactcctaacgactactacgtccgtacggtaccagacgacgaacgccggtcggacccgtacggtcccttaccccgtaggtttcccctacgtagttccgtagtccggtaccggtacccggggtacccaccggtacgggtcccctaacggtccgactaccgtacccaaggtaccgtacggttacgagggtacggtacggtacggttggggtaccgtgggaacctacgtaccgtttacctaaccgtccttacgaacttacgaacgttacgacgtaacgtccgttacgggaaccgtacgtaagtaacggttacgttccgtaagttcgttagttacctttacgtgttaaccgaggtaccgtaaggttacgtaagggttaccctccgttaacgtcggttccgttacggtacccgggaaacgtaacgggaacgttaaaggaacggtaaataacggtaacgtccggtagtcgtacgtacgaccaacgttcgtcgttacg

SEQ ID NO: 145885 - DNA, 733 bp, Homo sapiens
  misc_feature: GYAE6OF01BG4GV.21.4.A04.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgagggaaangccaccctctcctgcagctccagccagaatactccgagagctactacatcgcctggtaaccagcagaacgcctggcccaggcctcccgagttcctnatctatcgcgtcgggtacccagacgggccacgtcggctacgtcccagaccgaggtttcaggtcggacgaggttcgggtacgtgggtaactaggtacctttacgaccttctacgtaacttctaagttaacgcgtaacgtaccggttagggaacctccgttaaggtaacgttacgtttaccgacggttaaggtttacgtttaacctttacggttcgttaaccgtaacggaccgttaaaggtttaaccggtacggggtttaaaacctttccccgtaaacccgttttccggttacgggtttacccggtttaaccgggaaacccccggttaaaagggggtaaacccgtaaagggggtttaaacgaaacgggttaaaccggtaaaaaccgggttacgttgggtaccgggtacttacggaaccctacccttacggttcgtttaccg

SEQ ID NO: 145886 - DNA, 724 bp, Homo sapiens
  misc_feature: GYAE6OF01CRUMP.21.4.A04.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggctccaggctcagaaaccacggataattgtgttgacgcagtctccaggcctaccctgtctttcgctacgaaggggaaancgccctacctctcctgcacgcctccgacgccaagtaacttacnccgagtacgctaactacacgtacgccgttaggtaccaggacaacggaacgtccgtacgggacccgtaacgggtccccttaccccgtacgggtttacccctacgtaaccgtttaccgttacgtcgggtacccgttaccggggtaccccaagggaccggggtacccttacggtccggacctaaccgtcccgaaggtaccggtacggttaccgagggttacgacggttaagggtcgggttacggagggtaacctaggtaccctttacggacttaccgtacgtacttacgtacgttacgctaacggtacgtgaccgtacgtaggtaacttcgttacgacgttagttcgttatactgtacagtactagttacgtagtacgtactacgttcgtcgtaccggtacgacggaacggtaacgtaagtaagtaaacgtacggtaaacgtaggttggacgtaccgttaacggacctaacgtgtttcgttacgg

SEQ ID NO: 145887 - DNA, 713 bp, Homo sapiens
  misc_feature: GYAE6OF01E3GW7.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgctcgaggggaancgccaccctctcctgccagcctccagccagaatactccagacgcttaactacatacgcctaggtaccagcagaacgcctggccaggcctacccgaggttcctcatctagtcgctcgggtcccagacggccacgtggaccacgtcccagaccgtaggttccaggtcggacgtagggttggggtccgtaggggaacccagggttaccctttccgaaccgtttccgtaccgaatttaccgaacgttttaacggacgtaacgggttacccgtggggtaaccgttacccgtaggtaaacgttacgttttccggaacgttaacggtttcgtttaacgtttaaccgttggtaccgtaaggtccgttaaaggttaagtacgggttaacgtttccaaccgtttcgttcgggtttacccggttcggaacccggtaaacggggtaaaccgtaaacgggtaacgtaaacggacggtaaaccgtacggttagtacggtccgtacgacccgtacctgttccgttacgg

SEQ ID NO: 145888 - DNA, 725 bp, Homo sapiens
  misc_feature: GYAE6OF01D54LS.21.4.A04.1.454.CMB.1.raw
  modified_base (336)..(336): a, c, t, g, unknown or other
  misc_feature (336)..(336): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccaccggagaattgtgtgacgcagtctcaggccaccctgttcttgtctaccgaaggggaaagacgccaccctctcctgccagcctccacgaccaagtaactactaccagacgtactaactaacattacgccgttacggaaccaggaccaaggaaccgtccgtcggacccaacggtcctacccgtacggtttccctanacttcgtagtcgtccgttccgggtacccacggtacgggccctacgtcggacctacgtacccaagacgtacggttcagggtcggtacgtagggttcgggtcgtacgggactacgtacttacgtactctactacgtactaagttacgacgtacgtacggtcggtacgtacgtaaggtaaccgttagttccggataggtttagttacgtttaacgtcggtactaaggtacgtagttacgttaaggtaccgtttcctaacccgtcgttacggttcccggttaccggaaacccgggtaaagggtaacccgtaaagggtaaacgtaaacgggtaacggttaaacggtacggtcggtaccggtccggtaacgaccctaacgtacgtccggtttacg

SEQ ID NO: 145889 - DNA, 960 bp, Homo sapiens
  misc_feature: GYAE6OF01APEPD.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcacgaaaccaccggagaaattgtgttagacgcgagtctccaggccacccgttgttctttcgtctaccggaaggggaaacgacgcccacccctcgtcctgccgacgtcctaccgacgcctaagaacttacctaccaaggacgtacctactaacaacgttaccggtccgttacgggtaacccaaggaccgaacggtaaacgtcccggttacgggacccgtaccggggttcccccgttacccccggttaccgggtttccccttacgtacgttaccgttaaggttccggtccgggtttaccccggggttacccccgaaccggggtaccggggtacccctaccggttaccgggacccgtaaccccgttaccccggaaccggttaaccggttaccgggtttaccgtaacggggtccggtaccgggtaacgggtttccgggggttacggtacgggggaacccttaacggttacccgtttacccctaccgtttaccggtaccccgtaaccgtccgtaaccgtacggaaccgttaccgggtaacggttacccgggtaccgtaccggtaaacgggtttaaacgtttacgtttaccgtaacgttaacgttttaacggttaaccgtttacggttacggttaaacgtacgtaacgtttaacgtccgtaccccgttaaccccgtaaccccgttaacccccttacggttaccccttaccccgggttaccgggaccgtaaacccgggaacccttacggtacccgtaggaacccggttaaacggtaccgtaaacggtaaccggtaaccgttccgggaaccggttacccgcctaacccgtaccg

SEQ ID NO: 145890 - DNA, 683 bp, Homo sapiens
  misc_feature: GYAE6OF01ATBLT.21.4.A04.1.454.CMB.1.raw
  modified_base (204)..(204): a, c, t, g, unknown or other
  misc_feature (204)..(204): n is a, c, g, or t
  modified_base (332)..(332): a, c, t, g, unknown or other
  misc_feature (332)..(332): n is a, c, g, or t
  modified_base (667)..(667): a, c, t, g, unknown or other
  misc_feature (667)..(667): n is a, c, g, or t
tcagtcgtcgctcgcacgaccggtgctcgatttagagtagtgatcagggggagagctgctcagttaggacccagagggaaccatgggaaaccccagcgcagcttctcttcctcctgctactctggctcccagctcagaaaccaccggagaaattgtgttgacgcagtctccaggcaccctgtctttgctccgaggggaaagacncccaccctctcctgcagcctccgagaccaagaactactaccagacgctacctaacagtacgccttcgggtaaccacgaccgaagaacgtcccgtacggcccgaacggccttaccccgacggtttcccncctactacttacgtgccgttccggggtacccacggaccgggaccacgcggtaccacgtccccaaggacgtacggttacgacggtcggtcgaggtttcgggcttacggggactaaccggtctttcccgtattcctcgaactactaacgttaacgccgacgtaaccgttaggacggttaccgtaaggtaacgtacgttacgtcgtaagttacgttagttacgttgtacgtagtacgtagtagtacgggtacttactaccgtcttacgtcggttacggccggtaaacggaaccgtaacgggtaaatacgtaaggaaactacggtagtggcctagaccncgtaacgttccgtacg

SEQ ID NO: 145891 - DNA, 610 bp, Homo sapiens
  misc_feature: GYAE6OF01C5TBA.21.4.A04.1.454.CMB.1.raw
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
  modified_base (480)..(480): a, c, t, g, unknown or other
  misc_feature (480)..(480): n is a, c, g, or t
  modified_base (600)..(600): a, c, t, g, unknown or other
  misc_feature (600)..(600): n is a, c, g, or t
tcagtcgtcgctcgcacgaccggtgctcgatttagagtagtgatcgaggggagagctgctcagttacggacccagagggaaccatggaaaccccagcgcagcttcctcttcctctgctacgtctggctcccaggctcagaaacctcggagtaaattgtgttgacgcagtctccgagcaccctagtctttgctcagggaacntccactncctgctagctccagtccagatacncagagatacctagatagcctaggtaccaggctaaggaacgctaggacccaggcctccccgagttcccctagatccgtatcgacgtcgggtacccagacgggtcacgttgactactccganaccgaggttccagggtcncctaggtcggttcgaggtaacnctacgtctcttcnccgtataccatagacgagtagnggtaactctaggaaccttattccggattagttcggttaatacgtgttaaccgngtacgtaggtatacgggtactacctacgttacgacggttacgtaccggaaccggaacggtaacgtaaaggtaaacgtaagtaacgtaaacggtccgtagacggtacctacgacctaaccngttccggtac

SEQ ID NO: 145892 - DNA, 705 bp, Homo sapiens
  misc_feature: GYAE6OF01A2MQB.21.4.A04.1.454.CMB.1.raw
tcagtcgtcgctcgcacgaccggtgctcgatttagagtagtgatcaggggagctctgagagcggagccccagccccagaattcccaggtgttttcatttgtgatcagcactgaacacagaggactcaccatggagtttgggctgagctgggttttccttgttgttattttacaaggtgtccagtgtgaggtgcagctggtggagtcgtgggggagacttggtccagccgtggacgggtccctgagactctcctgtgcagcctctgctattccaccttcagtacgaccacaacactggacgtcgggtcccgccgaggccgtaccggaggggaacggggtcgtgggaggtcggggtccggtacgttaattaacgaaaggaaagtactaaacgtacgtaacaagtaacgaaggtaacgtaccgggcgtacggttcgtagggtaaggaaagggtaacggttaccaacctagtacctaacgaaaggtaagtaacttaggtaactttacgaaaacggtaacttacctaacgttacgtaacgtcctaagaacgtaaagtacgaaaccgacggtaaccctaaaccgggaaaaccgtacgggaaaccgaccgggtacccgttagtttaagttaacggtttaggtaagggtaaagaaacgggaaaagtaagggtaggtaggttagggtagggttagggtagtcggttaggtaacg

SEQ ID NO: 145893 - DNA, 709 bp, Homo sapiens
  misc_feature: GYAE6OF01EBAWM.21.4.A04.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagaaattgtgttgacgcagtctccaggcaccctgtctttgtctcgaaggggaancgccacctctcctgcagctccacgaccaagaatactaccagacgcttaactacatacgtccgtaggtaaccagcaagacgcctggaccaggcctccgagtttccanatctancgcgtcgggacccaggacggccacgtggacctactcccgagacgtaggttcaggttcggcgtaggttcgggtacgtacgggaactacggttacctttacgaactttccgtactaacgtttacgaaacggtttacgaaccgtaacggtaaccggttgggaaccgtaccgtaaggtaacggttacgtttacggaccgtaagtttagtttaactttacgtacgttacgagtaaccgtaaggtacgttacggttacttacctccgtttacgtcggttacccggttacggaacccggtaaagggtaaccgtaaagggttaaacgaaaggttaacggaaaaccgtaaccggttggtaaccgggtccttaaacggccctaaaaccgttgttaacccgttacg

SEQ ID NO: 145894 - DNA, 879 bp, Homo sapiens
  misc_feature: GYAE6OF01AH2VD.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtgggtggagtcggtgggggtagacgttggtccagccgtgggtacgggtccctagacgtacctcctccgtgtcgcacgccctctcgctacttcctacccttacacgttcgaaccctaaccaaactagtacgggtaccgtccgggtcccggcccgacgggcttacccgggaagggggaacgggcggttgggacgggttcggggtaccgggtaccggttaagtaacggaaaagggtaaacgtaaccgttaaacgtaacggtttaacgaaacggttaacgtaaacggtaaacgttaacccggggacggtaacccggtttacggtaagggttaacgggaaaaggggtaacgtttacccgaaaccctaacgttacctaacgtaaaaggtaacggtaattaacggttaaacttaacgaaaacgtaaacctttaccgtaaacgtttaggttaaccttacgtaaggtaaaccttaaacggtaaccggtaaaccgaaaccggttaacccgtaaacgggaaaaaccccggggtaacgggtaaacccggtaacgggttccccggttaaggtttaactttaaagggttaacgggttaacgggtaaacggtaaaaccggtaaaaaggggtacgggttaaagggtagggttacggggtttaagggtaggggttaacgttcggttacgggttaacg

SEQ ID NO: 145895 - DNA, 725 bp, Homo sapiens
  misc_feature: GYAE6OF01C0STP.21.4.A04.1.454.CMB.1.raw
  modified_base (146)..(146): a, c, t, g, unknown or other
  misc_feature (146)..(146): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctccaggctcaagaaaccacgganaaattgtgttgacgcagtctccaggcacctgtctttgctcgaaggggaaangccacctncctagcagctaccagcaagaatatccagnctactacatacgctggaccngcaagaacgcctaggccaggcctcccgaggttccctacgtatctatcgcgtcgggtacccacgacgggtccacgtcggactacgtcccaagtaccgtaggttcaaggtcggacgtagggtcgggtcgtaggaacgtaacgtaccttcgaaccgttctacctacgtacgtaacgttaacggaccgaaggtaaccgttacggggtaactaacccgttaggtaaaacgtacgttttaccggacgttacgttaacgggtttaactttaaccgtaggttaccgaaggtaccgtaaaggttcggtttaacggaaacggtttcccgtaaaccgtttccggttacggtttacccggtttaccgggaacccgttaaaacggggaaacccgtaaagggtaaacggtaaaacgtttaacggaaaacggttaaccgtaggttacgggtacctaccggtaacaccccgtaagttcccggttacg

SEQ ID NO: 145896 - DNA, 776 bp, Homo sapiens
  misc_feature: GYAE6OF01BKSA5.21.4.A04.1.454.CMB.1.raw
tcagtcgtcgctcgcacgaccggtgctcgattttagagtagtgatcaggggagagctgctcagttaggacccagagggaaccatggaaaccccagcgcagcttctcttcctcctgctactctggctcccaggctcagaaaccacggagaaattgtgttgacgcagtctccaggcctaccctgtctttgtctaccgaggggaagcgccaccctctcctgcagcctccacgccaagtaatactaccagacgtacctaactacatacgccgttacgaccagcagacgtccgcggccgacgccttacccgtacggtttcccactacttctagtcgcggtccgggacccacggacgggtacccacgtcggaccacctaccgacgtaccggtacggtttacgcgggttacggtaccgggtagggttccggggttacggtacggggtaacctaaccggttacttaccgtaccttacctaccgttaattaccgtaattaccggacgtaacggtacgtacggtaccggtacgttagtaacgttacgtttcggtaacgttaggtttacgtttaacgtttacggtagttacgtacggttaacgttaaggttacgttaaccggggttaccgtttaccgttcccggttacggttccgggtttaaccgggttcccgggaaaccgggtaaacgggtaaacccggttaaaggtaacgggttaaacggtaacggttaaaacgggtccgttaagggtcgtaccgttaccggaacctccgttagttccggttacc

SEQ ID NO: 145897 - DNA, 832 bp, Homo sapiens
  misc_feature: GYAE6OF01CP3T6.21.4.A04.1.454.CMB.1.raw
  modified_base (622)..(622): a, c, t, g, unknown or other
  misc_feature (622)..(622): n is a, c, g, or t
  modified_base (820)..(820): a, c, t, g, unknown or other
  misc_feature (820)..(820): n is a, c, g, or t
tcagtcgtcgctcgcacgaccggtgctcgatttagagtagtgatcaggggagagctgctcagttaggacccagagggaaccatcggaaacccagcgcagcttctcttcctcctgctactcgtcggcctccaggctcaacgaaaccgaaccgggaagtaaagttgtggttgacgcacgtctaccgacggcctaccgttcgttctttcgtcgtaccggaaggggaaacgccgacctaccctcctccgtcgaccacgcctaccgacgaccgaagtaactactccgaaggtaccgtctaacctaacgacgttacgtaccgtacggtaaccacgaacgaacggtaaccgccgtcggaccgacggtcccgtcccgtacggttccctacgacgttacgtacgtccggtccgttcccggggtacccaacgggtaccgggccctacggttaccggacctaaccgaccgtaaggaccgttacggtcggaggtcgggtacgtacgggttcggtacggtacgggtaacttacgtaccgttacgtccgttacctacgttaaccgtacttaacggtccgtaacgtaacggtacggttacggacggttacggaagttaacggtttacgttaaccggntttacggtttaagtttaccgttacgttcgtaacctacgtacggttaaattgttaacggttcgttaccttacccgtttgggttccgtacgggtaaacccggtaaacggacggggttaaaaccggtaaggttaaaaccggtaaaagtaacggttaaaccgggacgttacgggtacggttacccacggtacccttaaccgngtttccgtaacg

SEQ ID NO: 145898 - DNA, 721 bp, Homo sapiens
  misc_feature: GYAE6OF01CQXQE.21.4.A04.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtcctcaggccacccttgtctttgtctaccgaaggggaaacgacgccaccctctctgcagcctccagccaagaatacnccgagacgctaactacagtacgcctacggtaccagcaagaacgcctcggccacggccctccgtacggttccctacacttctatcgtcgtcgggtaccacgcggacctcgtcgcacgccagacgtgtacgaggtcggcgtaggttcggtcgtacggggaactacggtacttaccggtacttccgtactaactacgtacgtttacggacgtaacggtcgttacgggacgtaccgttaaaggaacggtttacgtttaccggtacgttagtttacgtaacgttttacgtacgttaacgagtacctaaggttaacgtacgggttaaccgttcctaccgtttacggttcgttaccgggttacccggaaaccggtaaacgggtacccgttaaaaggggtaaaccgtaaagggttaaacggtaaaaccggtaacgtttacgggtacgttacccggtacgtaacctacccgtaggttacccgtttacgg

SEQ ID NO: 145899 - DNA, 836 bp, Homo sapiens
  misc_feature: GYAE6OF01AP1YY.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctacagaaaccaccggagtaaatttggtgttagacgacagtcctccaggtccacccgttgttctttcgtcgtccgaagggggaaacacgccctacccttctaccgtgccgacgccttaccgagtaaccagaacttacaccgagacgtctaactacacttacgccttaggaccaggtcaaggtacgccgtcgaccgacgtccctcccgtaacgttccgtacattacgtacgttccggtccggtccgggtacccacgggtaccgggtacccacggttacgggaccctaccgttacccggaacgtaccggttaacgggttcgtaacgggttcggaccggttacggggtttcggtaccggtacgggaaccttacgtcctttaccggaccttccgtacctattaacgtaacgtttaccggacgttaacggttaccggtacgttacggtaaccgttaaggtaaaccgtttcgtttaacgggaccctttaagggttacttttaaacggttttccaaacggttaccgtaagtaccgtttagggttaacgttacggggtaacctttacccgtcgttaccgggtttacggtaaccggttaccccgggaacgtaaacggggtaacccggtttaaagaaacggggttaaactaaacgggttaaacgccgggtttaagccggttacgtacggtaacccacgtttgtaaaccgtttccg

SEQ ID NO: 145900 - DNA, 766 bp, Homo sapiens
  misc_feature: GYAE6OF01AD7F4.21.4.A04.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttatttacaaggtgtccagtgtgaggtgcagctggtggagtcgtgggggagtacgttggtccagccgtgggacgggtccctgacgtacctctcctgtgccagtccctntcggctacttacctaccttcaggttacacccaacaaacgtacgtacgggaccgttccggggtacccgaccgacggtccgtaccggaagggggtaacggggtcgtaggggtacggggttcggggtaccggtacccggttaaaggttaaccggaaaacgggtaaaccgtaacgtaaaccgttaaggtttaaccgaaggtaaaccgaaggtaacggaccgggtacgtacggttctagggtaagggaaaacgggttaccggttaccaacccgttagtacccgtagaaacggtataagttacgtaacgttaacaaagtaaccctcgtaacttagtaactcgtaccgaataaacggtacaaaccgcggtaaacccgaaggtaaaacccggacggtacccggaacggttacgttagttaaacgtttaaggtcggtaaggttaacgaaacggtaaggttacggtagtagggtttcggtagggtaggctacggtggtaacg

SEQ ID NO: 145901 - DNA, 814 bp, Homo sapiens
  misc_feature: GYAE6OF01C5THX.21.4.A04.1.454.CMB.1.raw
  modified_base (255)..(255): a, c, t, g, unknown or other
  misc_feature (255)..(255): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgtttgtttagttttacaggtcgtcagttgtgaggtgcagtctggtggagtcggtgggggacacgttcggaccagtccgtgggacggttcccnggacgtcgttcctccgtgtcgacgacgtcccttcgtcggaccttacgttccctaccttcgaccgttaccgaaccctaacgaaacctacggttaccgggaaccgttccgggggttaccccgaccggtacgggtcccggtaacccggggtaaacgggggaacgggggttcggtaggggtacgggttccgggggtacccggtaaccggttaaacgtttaaacgggaaaaggtaaacgggttaaccctaaaacgttaacggtaaacgtaacggtaaacgtaacggtaacggtaccggtcggtaccgttaggtacgggtaagaacgggttacgttaccacgtactacgtacgaaggtaatgtaacgttaacgtaacgaacgtaacctaccgtattacggttacttacgtaacgaacttaaaggaccttaaacgacgttaaccgaacggaaacggtacgaccgacggttccgttagtaaagtttacggttaggtaagggtaataaacggaaaggttaggacggtttaggtacgggttaggttacggtagtccggtagttaccggg

SEQ ID NO: 145902 - DNA, 886 bp, Homo sapiens
  misc_feature: GYAE6OF01B2CWM.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccaccctgttctttgtctaccgaggggaaancgcccaccctctcctgcagtcctcccagaccaagaactactacccgaaggtacgtccttaacctacaataacgtcccgttacggtaaccccaggaccaaggaaccggcccgttacgggcccgaacgggtccccttacccccgtaacggtttcccctactacgtttccgttataccgggtccggttcccgggggtaacccctaaccgggaccggggtacccctaaccggttacgggacccctaaccgttacccccgaaaggtaacccggttacgggtttaccgaacggggtttccgggaccggttaacggggtttccgggggttacggttaccgggggaaacccttacgggttaacccttttacccacccttcgtttacctaacgttaccgttaacgttaaccggacgtaacggtacgtacgggaaccgttacccggtaagggtaaacgttacggtttaccggtaacgttacgggtttacgtttaaccgtttaacgtttcgtaccgtacggttacgtaaggtttacgggttaacgtttaacgttacccttaccgttccgttaccgggttccggttaccgggaacccgggtaaacgggtaccgtaaagggtaaccgttaaaggtaacggaaaacggtacgttagggtacggtactaccggtaacctaccgtagttcggttacc

SEQ ID NO: 145903 - DNA, 815 bp, Homo sapiens
  misc_feature: GYAE6OF01A1XBJ.21.4.A04.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagccgtgggacgggtccctggacgacctcgtcctgtcgcagccctctgcctagttcctaccctttcgagttacgacccaacgaacagtcggacgtgggtcccgccgaggcctccggaggggaacgggcgttagggaggttcggggtaccggtacccgttaagttaaccgaaagggaaacgtccgttaaaacgagtttaaccgaagttaacgaaggaacgttaccgggcgtaccgtacgttaggtaaggaaaacgggttacgttaccaaacccgtagttaaccgttacgaaaacggtaagtaacgttaacggtaactttaacccgaaaaacgtaaaccttacccgtaaacgtttaccgtaaacgtttccttaaggaaaccctaaaaggttaccggaaaaccgtaaccggtaaccccgttaaacgggaaaaacccggaccggggtaaacccgtaacccggggtaccgttaaggttttaaaccgtttagggtttacgggtaacgggtttaaacggaaaaccggtaaaaaggtcggggttaaggtaacgttacggggttacgggttagggtaacgtggttacggtaaaccgg

SEQ ID NO: 145904 - DNA, 837 bp, Homo sapiens
  misc_feature: GYAE6OF01AT6EU.21.4.A04.1.454.CMB.1.raw
tcagtcgtcgctcgcacgaccggtgctcgattttagagtagtgatcaggggagagctgctcagttaggacccagacgggaaccattggaaaccccagtcgcagcttcttcttcctcctgctactctgctcccagctcagaaaccaccggagaaattgtgttgacgtctagtctccaggtcaccctgttctttagtctacgaggggaacacgcctacctctcgtgcacgcctcagccgagaatctccagcgtctaacgtacactacgtccgtaggtaccctagaccgtaacgaacgtcccgtacgggaccctacgggtccccttaccccgtaagggtttcccctacgtaccgttaccgttacgttccggtaccgggttacccgggttaaccccgaacgggttaccgggaccccgtacggtttcggggtccaaaaccccggtttcccgaaacggtaccgggttaacgggtttaccgaaggggtttcggtaccggtaacggggtttccggggtaccgttccgggggaaacccttacccggtacccgttttaccgtacgtacccgttacggtaacttacccgttaagttaaccgggacctaacgggttaccgtaacgggttaccgtacccgttaaagggtaaaccgtttacgtttaccgggaacctttaacggtttacgtaaccgtttaggtaccgttaaccgagtaacgttaaggttccgaagttacccgtccttacgtcgtaccggtttcggaccggtaacggtaacgaccgtaaagggtacctaagtaaaccgtcggtaatcggtacgtcttaccgagtacccgtagttcccgttaag

SEQ ID NO: 145905 - DNA, 752 bp, Homo sapiens
  misc_feature: GYAE6OF01CPX3E.21.4.A04.1.454.CMB.1.raw
  modified_base (210)..(210): a, c, t, g, unknown or other
  misc_feature (210)..(210): n is a, c, g, or t
  modified_base (567)..(567): a, c, t, g, unknown or other
  misc_feature (567)..(567): n is a, c, g, or t
  modified_base (581)..(581): a, c, t, g, unknown or other
  misc_feature (581)..(581): n is a, c, g, or t
tcagtcgtcgctcgcacgaccggtgctcgatttagagtagtgatcagggggagagctgctcagttaggacccagagggaaccatggaaacccagcgcagcttctcttcctcctgctactctggctccaggctcaagaaccaccggagaaattgtgttgacgcagtcctaccgaggcctaccctgttctttgtcctaccggaaggggaaancgccacctctcctgcacgcctaccgacgaccaagtaaacttacacccgaaggactacctaactaactagttaaccggccgttacgggaaacccaggaccgaaggtaaacggcccgttacggggacccgtacgggaccccttaccccggtaacggtttccctacgtaactttcgtacgtcggtccgtacccggtacccgaggtaccgggccctaacggttcggcctaaccgtacccgaaggaaccgtacggttcaacgggtcggaacgttagggtcgggtacggacggaaccacgtttactccgttacgtcgtactactactagtcgaacgtaggtacgtaggcgtactaagtacgtnttcgacgttagttntacttgcgtatacgtagtagtacgtaacgttccttactccgttcgtcgggttaacccggtcggaaaccggtaaacggggacttaaacgggtaaaacgtaacggttaaacgggtaaaccttacgggttgggtacggttacctaacgacccttaaacgttgtttaccgttccg

SEQ ID NO: 145906 - DNA, 860 bp, Homo sapiens
  misc_feature: GYAE6OF01BX6A7.21.4.A04.1.454.CMB.1.raw
  modified_base (190)..(190): a, c, t, g, unknown or other
  misc_feature (190)..(190): n is a, c, g, or t
tcagtcgtcgctcgcacgaccggtgctcgatttagagtagtgatcaggggagctctgagagcggagccccagccccagaattcccaggttgttttcatttggtgatcagcactgaacacagagactcacatggtagttggctgagtcttggttttcttgttgttatttacaggtgtacagtgtcgaggtncgagcgtagggtggagtcggtagggggactacgtttcggtacccgaggtcccgtgggggtaaccgggttcccctaggaacggtccttccgtacccgttgggccgaccgtacggtcccttaccgttggaccttactttacccgtaccgtttacgaggttaccgaaccctacgaaacgtacgtacggacggtcgggtaccgcgacggcctaccgggaagggtacgggcgttagggacggtacggtccgtaaccggtaattaaaccggaaagggtaaacgtaccttaaaacgtaacgggttaaacgtaacggtaaacgtaaacggtaaaccggttacgggacccgggtaaccggttaggtaacgggtaacgggtaaaacgggggtaaccggtttaccaaccggtacgtttaaccgaacgtaaaggtaaacgttagttaacgggtaaactttaacggaaaaacctaccggtaacttaacgggttaactacgttacccgtaaggtaacccgtaaagtaaccgaaacgtaccgttaaccggaaaaccggtaaaccgggaacggtaacgaccgggttagtaacgttaacgttaggttaacgggtaagtaaacggaaaagttaaacgggacggtttaggaaaggttcgggtagggttaaggttacgtgttacggaacg

SEQ ID NO: 145907 - DNA, 865 bp, Homo sapiens
  misc_feature: GYAE6OF01DN9FO.21.4.A04.1.454.CMB.1.raw
  modified_base (199)..(199): a, c, t, g, unknown or other
  misc_feature (199)..(199): n is a, c, g, or t
  modified_base (849)..(849): a, c, t, g, unknown or other
  misc_feature (849)..(849): n is a, c, g, or t
tcagtcgtcgctcgcacgaccggtgctcgatttagagtagtgatcaggggagagctgctcagttaggacccagttagggaccatggaaccccagcgcagcttctcttcctcctgctactctggcctcccaggctcaagaaaccaccggagaaattgtgttgacgcagtctcgagcacctgttcttgtctcgaggggaancgccaccctctccgtgcacgcctaccaggaccaagtaactactcccgaaggactcctaactaacagttacgccgtagtaaccaggacaaacgaaccgtccgtacggacccgaggtccccttaccccgtaacggtttccctacctacgtttacctagtccgtaccggttccgggtaccccaacggtacgggaccctaacgttcggggaacctaccgttaccccgaaggtacccgttagggtttaccgaacggttcgggacgtacgggggtttcggggttaccgtacggggaacgtacggttaccgtttacctaaccgtttccgtacgtaaccttacgttaacgtttaacggaccgtaaacggtacggttaacgggtaacgttaccgtaacggttaaaggtttacgtttaccggacggtttaacggttacgttttacgttaacggtacggtttaccgaagtaccgttaagggttacgtaacggtttacgttacccgttaccggttacgtttaccgggttaaccggttccggggtaaaccgtaaaacccgggggttaaacgtaaaggggttaaacgtaaaaccggttaaaccgggtaaaacggttaacccggtttaggggacccggttaactaacccgggataaccccggttnttcccgggttttaacg

SEQ ID NO: 145908 - DNA, 797 bp, Homo sapiens
  misc_feature: GYAE6OF01DX96Z.21.4.A04.1.454.CMB.1.raw
  modified_base (198)..(198): a, c, t, g, unknown or other
  misc_feature (198)..(198): n is a, c, g, or t
  modified_base (321)..(321): a, c, t, g, unknown or other
  misc_feature (321)..(321): n is a, c, g, or t
tcagtcgtcgctcgcacgaccggtgctcgatttagagtagtgatcaggggagctctgagagcggagccccagccccagaacttcccaggttgttttcatttggtgatcagcactgaacacaggagactcaccatggtaggttgggctgagtcgttgggttttccttgttgtttatttacaaggtgtcagtgtgaggtncagcgtggtggaggtcggtggggatacgttcggccaggccgtgggacggtccctaggacgtacctcgtccgtgtcgccagtccctcgtcgcttacttacctaccttcgacgtacgaacccaanaacctaggtacggaccgtccggggtacccgaccggacggtccgtaccgggaagggggagggtcgtagggtagggtcgggtccggtacgtaacgttaacggaaaggtaacgaaccttaaacgacgtttaacgaagttaacgaaggtaactaccgggcgtacgttaccgtaaggtaacgggtaaaacggtaacggttaccctacaacgttacgtaaacgaaaggtaagtaacgttaacgtaacgttaaaccgtaaaagtaaccctacgtaaacgttgtttaaacaccgttaacaaacgtaaacgtacgaaaccgtaaccgtaaccgaaacggtaaaccggaacgggtaccgtacccgggttaacttagtttaagttaaccggttggtaaaacggttaaaggtaaaacgtaaagggtaaggggttaacgtaagggtttggtaacggggtttagggtaccggtaaggtcggttaaaccgg

SEQ ID NO: 145909 - DNA, 848 bp, Homo sapiens
  misc_feature: GYAE6OF01C0NZU.21.4.A04.1.454.CMB.1.raw
tcagtcgtcgctcgcacgaccggtgctcgatttagagtagtgatcagggggagagctgctcagttaggacccagagggaaccatggaaacccagcgcagcttctcttcctcctgctactctggctcctaggcctacaacgaaacccgaccggaagtaaattgtgttagacgcacgtctacgacggccacccgttgttctttcgtccgtaccggaagggggaaacgccgacccctacccttcctccgtcgaccgacgtcctaccgaacggaccctaagtaaacttaccaccgaaggaacgtacctaactaacacgtacgtacccgttacggaaccacgacgaacggacgtaccggtcggaccggacgtacccttcccgtacggttacccttacgtaacttcgttacgtcggtaccggttaccggggtacccaacgggtaccggacctacggtcgacctaacctcccgaaggaccgtaggttcgacgggttaggcgtacgggtcgggtcgacgggaccacgttctactacgttcactacgtacgtacttacggactacggtacgtaggtaccgtacgttaaggtacgtttacgttccacggtttacgttaggtttaacttttacgacggtacgtacggtaagttacggttagtttaacgggttacgtttacccttaccggttacggtttcggttaaccggggttacccggaaacgggtaaaccggggttaaaccggttaaaacggtaaacggttaaacgggttaaacgggttaaaacccggttaacggttaacgggttcccgtaaaccggttacgtacccttaaacgtaccgttttcggtttaaaccccg

SEQ ID NO: 145910 - DNA, 739 bp, Homo sapiens
  misc_feature: GYAE6OF01A2IQH.21.4.A04.1.454.CMB.1.raw
  modified_base (707)..(707): a, c, t, g, unknown or other
  misc_feature (707)..(707): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaaccaccggagaaattgtgttgacgcagtctccaggcctacccttgttctttcgtctaccgaaggggaaagacgccctaccctctcctgcacgcctccgagccaagtaacttactcccgaaggtacgtccttaactacctaagtaaccggtccgttacggtaacccaaggaccgaaggtaaccggtcccggtacgggacccgtacggtccccgttacccccgtaagggtttcccctactaacgttcttacgtccggtaccggttaccgggtaccccaacgggacgggtcccctaacggttccggacctaaccctacccgaacgtaccgtacggttcgaagggttcggccgtagggtcgggtcgtacgggactacgtcctttaccgacttcctacgttactacgtagttacggcgtaacggtacgtaggaccgtcgtaacgttaacgttacgttcgacttagttaggttaactttcggtacgactacgagtacggtagttacggtacttccgtcttaggtacggttaccgtacggaacgtaaccgggaacaaaggtacgaagtaagtaacgnggtcgtacgactacgaccacgtcgtcgttacg

SEQ ID NO: 145911 - DNA, 808 bp, Homo sapiens
  misc_feature: GYAE6OF01ERIVM.21.4.A04.1.454.CMB.1.raw
tcagtcgtcgctcgcacgaccggtgctcgatttagagtagtgatcaggggaggctctgagagcggagccccagccccagaattcccaggtgttttcatttggtgatcagcactgaacacagaggactcaccatgggaggtttgggctgagtcgttgggttttccttgttgtttattttacaaggttgtccagtgtgaggtgcagtctgggtggaggtcggtgggggagtacgttgggtccaggccgtgggacgggtccctgacgactcctccgtgtgcagtcctctgctacttcctaccttctaggtacgaaccaccaaacgtacgtacgggtaccggttccggggtacccggccgaacggggtccgtacccgggaaggggggtacgggggtcgtgggggtacggggttcgggggtccgggtaccggttaacgttaacggaaaggtaaacgtacttaaacgtacggttaacaacggtaacaacggttaaacgtaccgggcgtacggtacgtaagggtaacgggtaaaggggtaacgttccaaaccctaggttacctaacgaaaggtacgtaattacggtaaacttaacgaaaacgtacctaacgtagtacgtttaactaccgtaagaacgtaaagttaccggaaacacgggtaaacccgtaaagggaaaaccccggagggtaaacccgtaccgggtaaccgtttaagtttaacggttacgttaggggtaaacggtaagtaaaaacggtaaaagggtgggttaacgggtaagttggggttagggttaggtaacggtcgtaagggtaccg

SEQ ID NO: 145912 - DNA, 888 bp, Homo sapiens
  misc_feature: GYAE6OF01D7CPG.21.4.A04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagagtagtgatcaggggagagctgctcagttaggacccagagggaaccataggaaaccccagcgcagcttctcttcctcctgctactcgtggctcccaggctacaacgaaaccaccggagtaaattgtcgttgaccgcacgtctccgaggcctacccttgttctttcgtcctaccggaaagggggaaacncgcccctacccttcctccgtgcctacgccctaccacggaccaagtaactactaccgagacgtaccttaacctacacgttacgtaccgttacggtaacccgacgacgtaacggaaaccggtcccgtacgggacccgtaacggtccccttaccccggtaaccgggttttccctacgtaaccttccgtttaacggttcggtacccggtttcccggggtaccccgaacgggaccggggtacccctacggttcgggactacccgtacccgaacggtaccggttacggttaccgtaggtccggtacggtagggttcgggttaccgggtaggaaccgtaaccggttacctttacccgtaccttaccgttactaacgtttaccgtaagtttaaccggaccgttaacggtaacccggttggtacccgttacggtaaggtaaacgtttcgttaccggacgtttagttacggtttacttacggttacgtacgtacgtaacggttaacgttacgggtaacgggtttaaccgttacccttacggttcgtacgggttaccggttaccgggtaaccggtaaacgggtaaccggtaaaggtaaacggtaaaccgttaacgggaaaccgttaagggttcggtacggtcgttaaccgacttaccggttaatcgtttaaaccgg

SEQ ID NO: 145913 - DNA, 822 bp, Homo sapiens
  misc_feature: GYAE6OF01BEWZP.21.4.A04.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggganacgttggtccagtcccgtgggacggggttcccctaggacgacctcctccgtgtgaccagcctctgcacttccaccttcagtcgaaccaacaacagtcggacgtcggggtaccgcccgacgggccgtcccggaagggggaacggggtcgttaggggacgggttcgggggttccggaccgttaagttaaccggaaagggtaaagtaccgtaaagtaacggtttaaacgaggttaacgaaggtaacgtaccgggaccggccgttaccgtaggtaacgggaaaagggtaacggtttacccaaccgtaactaccgttaaccggaaagtaacgtaacgttagtaaacgtttaaccgaaaaagttaaccctaacgaactttaggttaacttccgtaacgtaagtaaaacgttaacggaaaactaccgggtaaccttaaacgggaaaaaccccggtaggggaacccacccgggggtaaccgtttacggtttaaacgtttaacggtttacgggtaacgggttaaagaaaaccggtaaaaagggttaggggtaagggttaaacggttggggtttaaggggttacggggttaggttccggttagggttaaacccgg

SEQ ID NO: 145914 - DNA, 852 bp, Homo sapiens
  misc_feature: GYAE6OF01BKHEK.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccgaggggaaacngcccaccctctcctgcacgcctaccagaccaagaaacttactaccgaagacgacctaactaacgtataaccggcctagggtaaccagccgaagaacgcccgtaggacccaagggcccttaccccgtacggtttcccctacgtaacttccgttaagtccggtacccggtttaccggggaccccaacgggtaaaccgggtcccctaaaccggttcgggaccctaaccgtccccggtaaacggtaaccggttacggtttaccgaacgggttcgggaccgtaaggggtttcgggttaccgtacgggggaaacctaccgggtacctttaccaacgttaccgtaccgtattacctaaggtttaccgacgtaacggtacgggtaggaacggtcccgtaaggttaaacgtttcgttacggacgttaacgttagtttacgttacgttacggtacgaagttaccggaagttaacggttacgggttaactttcccggaccctttcggtaccggtttaaccgggtcccgggtaaacccggtaaaccggggttaaaccgttaaaggggtaaaccgtaaagttaaaccggggtaaaaccgtacggtttaaccgggacgggttaacggaccggttacccgtaaccgttagttcccgttttaacccgg

SEQ ID NO: 145915 - DNA, 754 bp, Homo sapiens
  misc_feature: GYAE6OF01BN3H5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttatttacgaaggtgtccagtgtgaggtgcagcgtgggtggagtcggtgggggatacgttggtaccacggtccgtgggacgggtccctggacgtacctccgtccgtgtgccgacgtcctcgtgactacttcctaccttacgacgttccgaaccaactaacgacgttacgggtaaccggtccggggtacccgaccggtacggcccgtaccgggaaggggaacggggtcgtagggtacgggtcggggtaccgtacgttaagtaacgaaaggaactaccgtaaagtacgtacgaaggtaacaaggaacgtacgggcgtacggtcgtaggtaaggaaacgggtacgttaccaacctacgtaacgtacgaaagtaacgagtaacgtaacgttaacaaacggtacctacgtaacgtcgttaactacgtagtaaaccgaaagtacggaaccaacgtaccgtaaaacggtaaaccgcggggaacctcccgggtaagttacttaacgtttaagtcggttaaaggtaaacgtaaaggtaaagggtacggtaggtacggttagggttacgggttagaacggttcgtaaggttaaccggg

SEQ ID NO: 145916 - DNA, 777 bp, Homo sapiens
  misc_feature: GYAE6OF01EPHL6.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaccacggagaaattgtgttgacgcagtctcaggcacccgttgttctttcgtcctacgaaggggaacncgcccaccctctcctgcacgctaccagtccaagtaactactaccgaagtcgtacctactaacagtacgtccgtacggtaaccagcaagaacgccgtacggaccacgggtccctacccgtaggttccctacgtacgttacgtacgtcgtacggttcccggggtacccaacggaccgggtacccacggttacggcctaccgttacccgaaggtaccgtaggtttaccgagggttcggtacggtagggttcgggtacggtacgggaactacggtaaccttcgaaccttcggtacctacgttagtaaccgttacggacgtacgtaccgttggtaacctcggtaagtacgtttcgttacgacggttagttaggttacttacgtggtacgtacggtagtttaacggttaacggtggttaacccgtttccgtaacgtttccgggttacggttaccgggtaaccgggtaaacccggtaaaccggggtaaacgtaacgggttaaacggttaaaccggtaaacgtaaacgggtacgttcggtacggacttaccgaaccccgaagtttccgtgtttaccccgg

SEQ ID NO: 145917 - DNA, 882 bp, Homo sapiens
  misc_feature: GYAE6OF01B4MGG.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgtttgtttattttacgaaggtgtccgagtgtggaggtgcgagtcgtgggtggagtcggtagggggagtacgttcggtccgacggtccgtgggtaccgggtccccgtaggacgtaccttccgttcctggtacgccgacgtcccttcgtcgtcctacttcctacccttacgacggttaccaacccaactaacgtaggtacgggtaaccggttccggggtcccacccggtacgggtccgtaaccgggtacgggggaacggggtcgtggggtaacgggttcggggtaccgtaccgttaagtaaaccgaaaggtaacgacttaaacgtaacgttaacaacggtaacgaagtaacgtccggaccgtacggtacgtagggtaaacggtaaacggggttaacgtacccgtaaaccgtacttaaccgtaaacggtaaagtaacggtaagttaaccggttaaacttaaaccgaaaaccgttaaaccctaccgttaacgtaacgtttaccgtaaccgtaacgtaaacgtaaaagtaaccggtaaacctaccgggtaaacccgttaaaccgggaaaaaccccgggtacggtaacccgggtaaccgggttacgttaaccggtttaagtttaacggttagggttaaaccggtaaacggtaaaggttaaaacgggtggtttaaacgggagttcgggttaggggttaacggttcgggttcgtaccggttaaacgg

SEQ ID NO: 145918 - DNA, 829 bp, Homo sapiens
  misc_feature: GYAE6OF01DT14L.21.4.A04.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccacggaagtaaattgtgttagacgctagtcctcgaggccacccttgttctttcgtcctaccggaaggggaaanccgccctacccttctccgtgaccgacgtcctaccgagaccaagtaactacgtcgagtacgtacctaactacgactacgtccgtacggtaccagacgaaggaacccgtccgtacggacccgtaacggtccccttaccccgttacggttaccctaccgtacgttaccgttacggtaccggtcccggttaaccccggggtaccccaacgggacccgggtacccctaaccggttccgggaaccctaccccggtaaccccgaagggtaacccggttacgggttacgaacggggttcccgggacgttaggggtttccgggtacggtaacgggtactaaccggttacccttacgtaaccgttctaacgtaacttcgttaaggtacgaccgttaggtaccgtaggacgtccgttaagtaccgttacgttccgaagttacggttagtttaaccgtcgttacgagtaacggtaacggtaagttaccggtaacggttacctacccgttaccgttcgttaccggtaccggttaaccggaacggttaaacggtaaacgtaacggaaaacgttaacgaacgtaacggtacgtaggacccgttacgaccacctaacgttcgtcgttacg

SEQ ID NO: 145919 - DNA, 794 bp, Homo sapiens
  misc_feature: GYAE6OF01C3V75.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaccatggaaaccccagcgcagcttctcttcctctgctactctggctccaggctcaagaaaccacggagaattgtgttgacgcagtctcgaggcaccctgttctttgtctccgagggaaacncgccacccgtctccgtgaccacgtcctaccgacgaccgaagtaacttaactccgaagtacgtaccgttaactaacgtagtaccgtccgttacggtaaccaggaccaaggaaccgtccgtacgggacccgaacgggtcctacccggttacggtttccctacgtacttacgtacgtcggtaccggttaccgggtacccaacggtacgggacctacggtcggacctaacctcccgagtaacgtcggttacgaggtcggacggtagggtacgggttacgtacggggtaacctaggtaccttacgtaccgttactacgtactacgtacgttacggacgtacggacgtaggacgacgtaaggtaacgttacggttaccgacgttagttacgtttaacgttacgtaggtacgtaacggtacgttaacggttacgttacggttaaccgttaccgttccggtttacgttccgggttaccggttaccgggtaaccggtaaaccggggttaaccggtaaacggtaaacggtaaacgttaacggtaaaacgggttaccgttaggtacgtaccggttacgaccgtaacccgtagttcccgtttaaccgg

SEQ ID NO: 145920 - DNA, 692 bp, Homo sapiens
  misc_feature: GYAE6OF01AZ69A.21.4.A04.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (375)..(375): a, c, t, g, unknown or other
  misc_feature (375)..(375): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgggagaaattgtgttgacgcagtcctccaggcacccttgtctttgtctccgaggggaaancgccaccctntcctgcagctccagccagaatatccagagctactacatacgcgtaggtaccagcagaacgccgtggaccaggcctacccaggttacctcagtctagtcgtcgtcggtccacggacgggcctacgtcggactacgtcccgaagaccgtacggttacgtaggnggcgtaaggtcgggtccgtaggggactacggtaccttaccaccgttcctacgtaactccgtaagttacggaccgtaacggtaacggttacggggtaacctaccgttaggtaaacggtttacttttaccgggaccgttaggttacggtttaactttacgttacgtaccgaaggttacgtaggttaggttaaccgtaacgtttcctaccgttcgttccggttccggtaccggtaccgaaacgggtaacgtaacggaacggtaactaacggtaaacggacgttaggacggtacctaggtaccaaccttagttccttacgg

SEQ ID NO: 145921 - DNA, 863 bp, Homo sapiens
  misc_feature: GYAE6OF01AH5JX.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttggttttccttgttgttatttacgaggtgtcagtgtgaggtgcagcgtggtggtaggtcgtgggggtagtacgttggtccgacgtccgtgggtacggtccctgacgtacctctccgtgtcgccgacgtccctcgtcgcctactttccaacccgttcacgttacgaccaacaacgtacgtcggaccgtcgggtcccgaccgtacggcctaccgggaggggaacggggcgtaggggtgggtcggggtccggtacgttaagttacgaaaaggtaaaccgtactaaacgtaacgttaacgtaacgtaacgaaaggtaaacgtacccgggacggtccggttaccgtagggtaaaggtaaacggggtaacgtttacccgaaccgtacgtttaccggaaaccgtaaaggaacgttagttaacggtaaactttaaaccgaaaaacgttacccgtaacgtaaccgttagttaaacttaccgtaagtaaacgttaaaccgacggttaaaccgaaaccccgggtaaccgtaaaaacccgggaaaccgggtaaccgggacccgggttaaccggttacccgggttaagttttaaacggtttacggttaaaggggttacgggtaaaaacgggttaaaaccggttaaaaagggttaccgggtaagggttaaacggtttcggggtttaggggttaaggttaccgggttaacgggttacggttaaccggg

SEQ ID NO: 145922 - DNA, 799 bp, Homo sapiens
  misc_feature: GYAE6OF01BQS21.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagagtactcgacctagtggagtttggcttggagtcgttgggtttttccttggtttgttattttacgaaggtctccgagttgtggaggtcgcgagtcgtggtggagttcggtgggggatacgttcggtccacggccgtgggacggtcccgtggacgtaccttccgtccgttgtacgcgtacgtcctacgttcgactacgttacctaccgttcacggttacaaccctaacgtaacgacggttcggaccggtcggtacccggaccgacgggtccgtaaccggagggggtacggcgtagggtaccgggttacgggtccgaccgtttaagaaccggtaaaggaaacgtcctaaaacgtacgtacaaacgttagaacggtacgtacgcgtcggtaactaggttaacggaaaaggttcgtaccctaacttacgtaaccgtaacgtaaaggtgtaaccgttaagacgtttaaacgaaaccggtactttaaccgacgttaacgttattaccgaacgtaaagttaaacgtcgaaaccgtaccggttaaccgaaacggttaaacccggcggaaccggtaccgggttacttaacggtttagtttaagtacggtaaagggttaaataaacgggaaggttacgggttaaggacggtttagggacgggttagtacggtaaccggtgttaaacccgg

SEQ ID NO: 145923 - DNA, 804 bp, Homo sapiens
  misc_feature: GYAE6OF01DOTQ4.21.4.A04.1.454.CMB.1.raw
  modified_base (196)..(196): a, c, t, g, unknown or other
  misc_feature (196)..(196): n is a, c, g, or t
  modified_base (790)..(790): a, c, t, g, unknown or other
  misc_feature (790)..(790): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccaccggagaaattgtgttgacgcagtctcaggcacctgtctttgctccgaggggaaancgccaccctctcctgcagcctccgagaccaagaactactccagacgcttaactacataacggccgttgggtaaccaggaccaagaaaccgtccgtacgggaccaacgggtcctacccccgaggttttcccacacttcgtacgtcgtccggtaccgggtaccccgacgacggggtacccacgttacgggcctaaccgttcccgaacgtaaccgtacgggttacctagggtacggaccgtaagggtcgggggttaccttacggggggaacccacggggttaacctttcccggaaccgtttcctacctacgttacgtaaacgtttcggaaccgtaacggtaaccgttaggggaccgtaccggttaacggaacgtttaccgtttcgacccgtttaggttagtttaaccgtttacgtcggttacgaacgtacgtaacggttaagttaccgggttaacgtttcccgacctttacggttacggttcccgggttaacccgggtaacgtaaaccggggtaaacccgtaaaggggtaaacgttaaaaggttacgggtaaaaacgtaccggttacgggtacggtcgttaaccgaccgttaacccngttttaccgtaacg

SEQ ID NO: 145924 - DNA, 821 bp, Homo sapiens
  misc_feature: GYAE6OF01AI5RL.21.4.A04.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
  modified_base (780)..(780): a, c, t, g, unknown or other
  misc_feature (780)..(780): n is a, c, g, or t
tcagtcgtcgctcgcacgaccggtgctcgatttagagtagtgatcagggagagctgctcagttaggacccagagggaaccatggaaaccccagcgcagcttcctcttcctcctcgctactctcggctcccaggctcaacgaaaccaccggaagaattgtgttgacgcagtctccaggcacctgtctttgtctcgaagggaancgccacccgtntcctgcgacgcctaccgagacctagtaaatacgtccgaagacgtacctaactaccaagttaccgtaccgtacggtaaccgagaccgaagacgcccgtggaccgacgtccgtaccctacggttccncgtactctacgtcgtacgttaccgggacctacggaccggaccctntaccggcgttaacctacccgaaggtactaaccggttcgtaacggttcggcgtaacggtgggtccgtaaggactaacgtactttcccgacgtcgttacctaagtacctaagtaacgccgtaacgttcgacggtcgtaacctaagttaaaccgttcgttccgtaagtaccggttttacgttaacgtttaccggtagttacccggttaacgtacgttaaaccggtttggtttaaccgggtttaaagttccccgtttaccggttaccgggtttaacccgggttccgttaaaccccgggtaccgggttaaaaccgggaaaccggttaaacgtttaaaacggggaaaacgttaccggtaaaaacccgggttaaagttaccggggttacgttaaacccgggtanaaacccccggttacgtttaaccgtacccgggtttaacccgg

SEQ ID NO: 145925 - DNA, 736 bp, Homo sapiens
  misc_feature: GYAE6OF01BKUCR.21.4.A04.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccgganaaattgtgttgacgcagtctccaggccaccctgtcttgtctacgaggggaaancgccaccctctcctgcagcctccacgacagaatactccagacgctaactacatacgtccgtacggtaaccagacaaggaacgccgtaggcccgaacggtccgtaccccgtaggtttcccacgtacttctacggtcggtaccggttaccggtacccacggaccgggaccctacggtcggaccctaaccgttacccgaaggtacgtaggtacgaggtcggacgtggggttcgggtacgtcgggaacgtacgtacgttccaaccgtctacgtactagtaacgttacgacgtaacggagtcgggaccgttacgtaaggtaacttcggtttaccgattacggtttagttacgttacgtggtaaccgtgtaagttacggttaaggtaacgttaccgttccttaacccggtccggtttaccgggttccggtaacccgggaacgggtaaaccggttaaacggaagggtttaaacgaaacggttaacgggtaaactaaccgggttcggaggtccacggtaacccttaacgtgtttccggtacg

SEQ ID NO: 145926 - DNA, 763 bp, Homo sapiens
  misc_feature: GYAE6OF01BPD3L.21.4.A04.1.454.CMB.1.raw
  modified_base (363)..(363): a, c, t, g, unknown or other
  misc_feature (363)..(363): n is a, c, g, or t
  modified_base (722)..(722): a, c, t, g, unknown or other
  misc_feature (722)..(722): n is a, c, g, or t
  modified_base (731)..(731): a, c, t, g, unknown or other
  misc_feature (731)..(731): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggtagttgggctgagtcgttgggttttccttgttgtttattttacgaaggttgtcctaggtgtggaggtgcagtcgtgggtggaggtcggtgggggactacgttggtccgagtccgtggggacgggtccctaggacgtaccttccgtccttggtcgacgacgtccctctcgacctacttctaaccttcgacgtacgaaccaacctaagacgtacgggtacgtcggggtcccnccgtaacggtccgtaaccggaagggggaacgggtccgtagggtagggttcggggtaccggaccgttaagtaaccgaaaggtaacgactaacgtaagtacaagtaacgaaggtaactacgggcgtacgtacggtaggtaggaaaacggtaccggttaccaactacttaccggaagtaaaagtgtaagtaacgtaatttaaaccgggaaaactaaaccttcttaaggttaaccgtattacgtaacggtaactaaagggtaccgtaaaccgacggtaaaccgtaaaccgggaaaaccggtaacggaccgggtacccggtattaagttacgttaggttaggacggtaaaacgaagtaaaaggnggttaacgngtttagggtaggagtttacggcgttagggtac

SEQ ID NO: 145927 - DNA, 795 bp, Homo sapiens
  misc_feature: GYAE6OF01BC7NZ.21.4.A04.1.454.CMB.1.raw
  modified_base (535)..(535): a, c, t, g, unknown or other
  misc_feature (535)..(535): n is a, c, g, or t
  modified_base (771)..(771): a, c, t, g, unknown or other
  misc_feature (771)..(771): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccgaggctacaacgaaaccaccgggaagtaaagttgttagttgacgctacgtcctccgacggcctacccttgttctttcgtccgtaccggaaggggaaacgaccgaccctacccttccgtccgtcgaccacgtcctaccgacgaccaagtaacttacaccgagtacgaccttaactacacgtacgtccgtacgtaaccgagtacaacggaacggtccgtacggccgaccggtacccgttacccggttacggtttcctaactcgttacgtacgtccggtaccggttccgggtaccccaaggtaccgggccaccggttcggacctacccgtaccggaacgttcgtacggtacgtaacgggtcggacggtagggttcgggtacgtacggtactacggtactcgtacttacncgtaactcgtacgtacgacgtacggtacgtacggtacgtacgtaggttaacgtcgttacgtacgtagtttacgtaacgtttctacggtactaaggtcgttaaggttaccgtaaggttaccgttaccgttaacgttcggttaccggtttcggaaccggtaaccggtaaacgggtaaacccggtaaggttaaacggtaaacgtaacggttaacgtaccggtcggtaacgtcccgttanaacccgccgttattcccgttaacg

SEQ ID NO: 145928 - DNA, 752 bp, Homo sapiens
  misc_feature: GYAE6OF01AWRRV.21.4.A04.1.454.CMB.1.raw
tcagtcgtcgctcgcacgaccggtgctcgatttagagtagtgatcaggggagagctgctcagttaggacccagagggaccatcggaaaccccagcgcagcttctcttcctcctgctactctggctccaggctcagaaccacggagaaattgtgttgacgacagtctccaggcctaccctgtctttgtcctccgagggaaagacgccctacccgtctcctgctcgctccgagaccagaatactccagactctaactacagtacgtccgtacgtaccgagagacgtaacgccgtacggcccgtaggccctaccccgtaggtttccctaccgagtttacctagtcggccttcggggtaccccacgggaccgggaccctaacggttcgggaaacctaccgttacccaacggtaccgtaaaggttttccgacgggttacgggcccgaggggttaacggggttcctaaggggtaccctacgggttaccttaccgccctttaagtcgtaaccttacgttacgtaacgtaccgtaggtaccggttaggtaacgacggtaacgtaggtacctttccgtaagtacgtttagtagttacctgtacgatcgtaacgttaggaacggtttacttccggaccttcggttacttacccgggtaccggttacggtaaacggtaccggttaaagggtaacgtaaagaggttaaaccccgtaaggtaccgtacggtaacgtcgtaaccgtacgcgtttacccgttaacgg

SEQ ID NO: 145929 - DNA, 715 bp, Homo sapiens
  misc_feature: GYAE6OF01DLWQT.21.4.A04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagtcgtcgctcgcacgaccggtgctcgatttagagtagtgatcaggggagagctgctcagttaggacccagaggaaccatggaaaccccagcgcagcttctcttcctcctgctactctggctcccaggctcacgaaaccacggaagaaattgtgttgacgcagtctcgaggcacctgtctttgctcgaggggaanctccacctcncctgcagcctcagccaanatactcagacactacncatacgcgtggaccagcaaggtaacgccgtcggtccgacggcctaccccgtaggttccctacgacttctagtcgtcgtccgggtcccacgacgggccaacgtcggaccactcccaagccgtaggttcaaggtggacgtagggtcgggttaccggtacggaacacggttacttacccgtacttccgtacttacgtaacgtaagtttacgacctaacgggtacgtagggtaactaccgtaggtaacgttacgtttcggtacgtaggttacgttaacgtttaccttcgggtaactacggtacgttaacgttagttaacgggttaaccgtttaccgtacccgttttacggttccggtttacccggttacccgggtaaaccgtaaacggggtaaacccgtaaaggttaaacgaaacggttaacggaaaacgtacggttaggtacggtacctcgaaccgtaaccttcgttcttaacccgg

SEQ ID NO: 145930 - DNA, 915 bp, Homo sapiens
  misc_feature: GYAE6OF01CEJ7T.21.4.A04.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggcctcccaggctcaacgaaaccaccggaagaaattgtgttagacgnagtctccgagccacctgtctttgctcgaagggaacncgccacctctcctgcacgtcctaccagaccaagtaactacnccgaagacgtaccttaacctaacacgttacgtaccgtacgggtaacccaacggacgaaacggtaaccgcccgttacggacccgtaacggggtcccctaccccggacggttcccttaccccgttaccgttaaccgttttaacccgccgtaacctacccgtaaccccgaaccgggtaacccggggtccctaaccggtttcggtacccggtaaccccgaagggtaaccgttaccggggttaccgtaaggggttccggggtcggggttaagggttaacgggttttacggggaacctttaaacggttttaccgtttttaccgaccttaccaaccgtaccttaccggaacgtccccgtaccctaaaggtagggttaacggtaacggttaaattacggtttcgttacgtttacctttaaggtttttacctacgtacgtacccgtaagttaaaccttaaaggtttaaacccgtttaacgtttacggtaccgggttaccgtaccggttccgggtttaacccggtaaccgggtttaccgggaaaccgggtaaaccgggggtaaaccgtaaacggggtaacgggttaaaaccctaaacggttaaacccggtaagttcgggttaacgacccgttacgtaaccttacccttagttaccctttcggtttaaccttcccgtacccg

SEQ ID NO: 145931 - DNA, 732 bp, Homo sapiens
  misc_feature: GYAE6OF01CSCQQ.21.4.A04.1.454.CMB.1.raw
  modified_base (251)..(251): a, c, t, g, unknown or other
  misc_feature (251)..(251): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctgctccaggctcacgaaaccaccggagtaaattgtgttgacgcagtcctccaggccaccctgtctttgtcctaccgaagggggaaagacgcccacccttctcctgccacgcctccgacgaccaagaatacnccaggtacactactacatacgccgtacgtacacgcaagaacgcctacggccacggtccctaccgtacggttcctacgtacttcgtagtcggtccgtccggtacccacggtacgggcccngtcgactaccgccgaagtaccgtaggttcgaggtcggaccgtaggttcggtacgaggaccacgttaactcaaccttcactacgtacgttagtacgacgtacgtacggtacggaacgtcgttaaacgacggttacttaccggtagttaacgttacgtttaactagttacgtacgttaacggtaacgttaaggttacgttaacgggtttaaccttccgttacccgtttcggttaccgggttaccggttaacccgggaaccgtaaaacggggtaacgtaaaagggttaacgaaacgttaaacgggtaacgttaacggttagggacggttacccgacgttaccaaccggttcgttacccgttaccg

SEQ ID NO: 145932 - DNA, 854 bp, Homo sapiens
  misc_feature: GYAE6OF01EHFER.21.4.A04.1.454.CMB.1.raw
tcagtcgtcgctcgcacgaccggtgctcgatttagagtagtgatcaggggagctctgagagcggacgccccagcccccagaattcccaggtgttttcatttggtgatcagcactgaacacagaggactcaccagtggtagtttgggctgagtcgttgggtttttccttgtttgtttattttacgaaggtgtccagtgtgaggtgcagtcgtgggtggtaggtcggtgggggatacgttggtaccacggtccgtagggtacgggtcccctggtacgtaccttccttccgtagtcgaccacgtcccttcgtcgtacctaactttccctacccgtttacaacggttaccgaacccaaacctaaactaggtaccgggtaccggttcggggtaccccggaccggaacgggtcccgtaccggggaacggggggtaacggggtcgttacgggggaaggggttccgggggttaccgggttaacccggttaaacgttaaaaccgggaaaaacggtaaaacgtaacccgtaaaacgttaacggtttaaaccgaacggttaaaccgaaaggtaaacggttaaccgggccggttacggttaccgtagggtaaacgggtaaaacgggttaaccgttccaaaccgttatacggtaaacgaaagtaaggtaataggtaaacctttaagaaaacgttcctacttacgtaattactcaagaaactaaagtaccgaacgaccggtaacccgtaaaggaaaacccgaggtacccggacggttaccgttgttaaacgtttaaggttacggtaagggtaacaaaaggtagtacgggtatacgttaggggttacggtaggttacgtgtggtaaccg

SEQ ID NO: 145933 - DNA, 795 bp, Homo sapiens
  misc_feature: GYAE6OF01DWM7O.21.4.A04.1.454.CMB.1.raw
  modified_base (781)..(781): a, c, t, g, unknown or other
  misc_feature (781)..(781): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagtaaattgtgttgacgcagtctccaggcctaccctgttctttgtccgtaccgaaggggaaacgcgccctaccctctcctgcacgcctaccgagaccaagtaactactaccaaggacgtaccttaactaactacgtacgtcccgttacggtaaccaggtaccgaaacggtaaccgtcccgtaggacccgacggtcccttacccccggtacggttttccctacgtacttaccgttacgtcgggtcccggtttacccgggtacccctaacgggaccgggtacccctaacggtaccggaccctaaccgtaccccgtaaacggtaccgttacgggttaccgacgggtcgggtaccggtaggggtttcgggtacggtacgggacctacgtaccttcaaccttccgtactagtacgtaacgttacgaccgtacgtacgtacggtacgtaacgtagtacgttaccgttagtacgttagttacttacgttacgtagtacgagtacgttagtaacgtacggttaccgttaccgtaccgttcgttacggtaccggtaccgtaaccggaacggtaaaccgtaagggtaaccgtaaaggtaacggaaacgttacggttcgtacggtacgtaaccgaccttaccgtnttcccggtttaccg

SEQ ID NO: 145934 - DNA, 730 bp, Homo sapiens
  misc_feature: GYAE6OF01B0E6T.21.4.A04.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagagtagtgatcaggggagagctgctcagttaggacccagagggaaccatcggaaaccccagcgcagcttcctcttcctcctgctactctggctcccaggctcgagaaccacggagtaaagttgtgttgacgtcagtcctaccgaggcaccctgttctttgtcgtaccggaggggaaacncgccctacctcgtcctgccacgcctccagacctagaaatctccaagtcgtctaacctacagttccgacgtacgtaccagcaaggaaccgtccgacgtccgacgggcccttcccgtacggttcctcgacgttaccgtagtaccgtccggttccgggacccgaccggtacgggcccttacggcgggtacctacgtacccgaagaccgttacggttcgtaacgggtcggtagtagggttaccgggttaaccgtacgggaactacggttaccgttaacccgtaccgtttcgactaacgttaccgttaacgtttaccgacgtacggaccgttaggaacctcgtaaggtacgttacgttacgacgttcgtttacgttacttcgttagaacgacgtacgtagtacggttacgttacgtacctacgttccgtacggttccggtacgaccggtaagaaccggtaagaaggtaacgaacggtaacgtaccgtggttaccgacgtacgtaccaaccttgtccgttacg

SEQ ID NO: 145935 - DNA, 781 bp, Homo sapiens
  misc_feature: GYAE6OF01AICKX.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttacaaggtgtccagtgtgaggtgcagctggtggagtcgtgggggagtacttcggtccgacggccgtagggacgggtccctggacgactctccgtagtcgctacgcctcgtcgtactacgttacctacctttaccgaggttacgaacccctaacgaaaccaggttacgggtaccggttccggggtacccgaccgtacgggtcccgtaccgggaacgggggtaacggggtcggttggggtacgggttcggggtaccggtaccggttaaagttaaaccgaaagggaaacgtaccgtaaacgtaacggttaaacagtaacgaaggtaaacgtacgggccgtacgtcgtaggtagggtaaacgggtacgtttacccaacgtacgtcgtaacgaaaggtactagtacgtaactaacgaaactaccgtaacgtactagttactcgtaacgtaacgtaaagaaccgaacgaccgtaacgtaacggaaaaccgaccggtacacccgggtacggtaagtttagttaaggttacggtaacggtaaagtaaacggtaaacggagggtttacggagggtttacgggtacgggtttaaggacggttccgttagggtaacccgg

SEQ ID NO: 145936 - DNA, 828 bp, Homo sapiens
  misc_feature: GYAE6OF01AT9YM.21.4.A04.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaancgcccacccttctcctgccagcctccagccaagatanccaagacgtctacgtacatacgccgtggtaccagtcaacgaacgccgtcgccgacggccttacccgacggtttccctacgtacttctagttcgccgttccgggtacccaaccggcgggccaacgtcggtaccacgtacccgaagaccgtacggtttaccgacggttagggcgtagggttcggtcggtagggaaccgtacggtacttaccgtaacgtccgtacctaacgttacgtacgttaacggacgtaacgggttaaccgtacgggtaaccgtaaccggtttaggaaaaggtttccggtttcgaaccgttaaaggttttacggttaacgtttacccggtttcgtaccggttaacggttaccgtaaacgggtttaacggttaccggggtttaaaccgttttaccaaacccggttttcccggtttacgggttaacccggggttacccgggtaaacccgtaaaaccgggggtaaaccctaaaacggggttaaacggtaaaaccggtaaacgggttaaaaacccgtaccgggttaacgggttaacggtaccccgttacgtaaacgaccccgttacgttccggtttaaccccg

SEQ ID NO: 145937 - DNA, 826 bp, Homo sapiens
  misc_feature: GYAE6OF01DKGRS.21.4.A04.1.454.CMB.1.raw
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
tcagtcgtcgctcgcacgaccggtgctcgatttagagtagtgatcagggggagagctgctcagttaggacccagagggaaccatcggaaaccccagcgcagcttctcttcctcctgctactctggctcccaggctcaagaaaccaccggaataaattgtgttagacgcagtctaccaggccacctgtctttgcctacggaaggggaaacgcgccctaaccctctccgtgacacgcctccacgccaagtaatacnccagtacgactaactanatacgccgtaggtaccaggacacggaacgtccgtaggccaaggtcctacccgtaggttccctacacgttctagtcgtccggtacgggtacccaacggtacgggaccctaacggtcgaccgtactacccgaaaggtaccgtacggtttaccgaagggtacggacggttaaggggttaccgggtacgggttaacgggaactaaacggttaccgttacgtaaccttcgttaacgtaacttaacgtaacgtttaacgggaccgtaaacggttacggtaacgggtaacccggttaaccgtaacgggttaacttacgtttacccggaagttaagttaccggtttaattaccggtagtacgaacggtagtaacggttacggtaacggttaaacgttcccgtaccgttaccggtttagggtaccccgtttaaacgggacccgtaaaacggggttaaaccctaaggggtaaaaacgttaaccggtaaaaggggtaaacctaacggggttacgttaacggggtaccctaacgtaaccccttaaccttacggttaccgtttaacgg

SEQ ID NO: 145938 - DNA, 668 bp, Homo sapiens
  misc_feature: GYAE6OF01A8UZI.21.4.A04.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (374)..(374): a, c, t, g, unknown or other
  misc_feature (374)..(374): n is a, c, g, or t
  modified_base (423)..(423): a, c, t, g, unknown or other
  misc_feature (423)..(423): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgttctttgtctccgaagggggaaanacgcccaccctctccgtgcagcctccagccagaatactccagagctactacatagcctaggtaccagcagaacgccgtggccaggcctccgtaggtcctnattccattcgcgtgggcccacgacgggccctagtggcctacgtcccgaagactacggttcgaggtgcgnggtagggtcctagggactcgtacttcgacctctacgatcctattacganagtacgtggaacgtctaaggagttacttacgcgtagttacgttactttaacgtcgtacgagtacgtaggttacgttagggttacgttacccttaaccgttcgttcgggttacccggtaccgggtaccggaaaacgggtacccgtaaaaaggggttaaccgaaaagttaacgggaaaacccgttaacgggttacggttacgggtaccccgtttaacgaccggttaccctaagttccggtttaaccg

SEQ ID NO: 145939 - DNA, 851 bp, Homo sapiens
  misc_feature: GYAE6OF01AI3YP.21.4.A04.1.454.CMB.1.raw
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccgaggcctacccgtgttctttcgtcctccgaaggggaaanccgccctacccttctccgtgaccacgtcctaccgacgaccgtaagaactacgtccgaaggactaccttaacctaactacgttacggtcccgttacggtaacccacggtaccaacggaacgtcccgtacgggaccccgtacggtccccttaccccggttaccggtttccctactaccgttaccttagtccggtaccggttccgggtaccccaaccgggtaccgggtaccctaacggttaccggaccctaccgtacccgagtaaccggttacggtttacacggggtcggtacgttagggtccggggtttaccggacggggtaaccttaccggtaccttttaccgaccgttaccgtacctaatttacccgtaagttacggaaccgtacggtaacggtaccggtacgtacccgttaaggttaaaccgtttcggttcgtaaccggttaggttttaacttaaccgtttccggtcgaaagtacgtaccggttaaggttaaccggtacgggtttaacccttccgttacctttcgggtaccgttacccgggtaacccgacggtaaaccgggtaaactaaagggtaccgtaaacggtaacgtaaaccggcgttcgggacgtccgttaacaaccgtcttacggttcttaccg

SEQ ID NO: 145940 - DNA, 701 bp, Homo sapiens
  misc_feature: GYAE6OF01B24ZT.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcagggaanatccacctctcctgcagctccagccagaatactccagagctactacatagcctaggtaccagcagaacgcctggccaggcctacccgaggttccctacacttctatcggacgtcgggtacccacgacgggcctacgtcggccacgtcccagaccgtggttcgaggttggcgtaggtcgggtactaggggaactaggtacttccgacgttctacattacgtaagttacggaccgtaaggtaccgtagggtaacgtacccgttaggtaaacgttcgtttaccggacgtaacggtttacggttaactttacgtttcggtaccgtaacggttacgtaaggtttacggttacgggttaacctttcccgttaacccgttcggtttaccggttacccggtttacccgggaaccggtaaacggggtaacccgtaaaagggtaaccgggtaaaatacgggtaaaaccgtacgggttacggtcggtaccgtacgacgtaactcgttcgttaccg

SEQ ID NO: 145941 - DNA, 866 bp, Homo sapiens
  misc_feature: GYAE6OF01EV3LE.21.4.A04.1.454.CMB.1.raw
  modified_base (148)..(148): a, c, t, g, unknown or other
  misc_feature (148)..(148): n is a, c, g, or t
  modified_base (231)..(231): a, c, t, g, unknown or other
  misc_feature (231)..(231): n is a, c, g, or t
tcagtcgtcgctcgcacgaccggtgctcgattttagagtagtgatcagggggagagctgctcagttaggacccagagggaaccatggaaaccccagcgcagcttctcttcctcctgctactctgctccaggctcacgaaaccacgganaattgtgttgacgcagtctccgaggccaccttgttctttgtcctacggaaggggaaagcgccctacctctcctagcacgtccnccgagaccaagtaaactacgtccaaggactccttaactacgaagtaccggtaccttacgggtaaccaaggccaaggaaccgtccgtcggggacctaacgggtccctacccggtaacggttttccctacgtaacttccgttaacgttcgggtacccggtttaccggggtaaccccacggggttaaccggggccctaaccggtttccgggaccttaaccgtacccgtaacggtaaaccggtacggtttcctaaagggggtccggtacgtaacgggggtttcgggttaacggtacccggggtaaacgtaacgtttacccctactacggttcctaacgttaaccttacgtaacgttacgacgtaacgggtaaccgttggtaaccggcttaagggtaaccttcgtttacggaacgttacgggtttacgtttaactttcgtaaccggttcaacggtcgttaaggttaacgttacgggttaaccggtttacctacggttccggtttacggtacccggggttaaccgaacccgggttaaaaggggttaaacgtaaacgggttaacggtaaaacgttaacggttaaacccggaccgttggaacccggtaccttacgaacccttagttccccgttaagttacccg

SEQ ID NO: 145942 - DNA, 800 bp, Homo sapiens
  misc_feature: GYAE6OF01BHTPT.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctcggctcccaggctcagaaaccaccggagaaattgtgttgacgcagtcctaccgaggcacccttgtctttgtctccgaaggggaaagacgccaccctctccgtcgcacgcctccagaccgagaactacgtccagacgtacctactacatacgccgtacgggtaaccagacgaacggtaacggcccgtacgggacccacggtccctaccccggtacggttcccacgtactcttacgtcgtaccgtcgggtacccaggacgggcccacggtcggcctaacgtaccccggagtaccgtaggtacgtaagggttccggacggtaacggggttcggggtacgtaggggtaaccctacgtaccttacctaaccgttcctaccgtacttaccgtaagtttacggacgtaaccggttaccgggtacgggtacgttaacccgtaggtaaacggtttaccgttaccggtaacggtaaggtttacgtttacgttacgttagtaccggtaaacgttcggtaaggttaacttacggggttaacgttacctaccgtttcgttacccggtccggggttaacccgggttacggaaaccgggtaaccgggtaaacggttaaacggtaaagtaaaccgggtaacgtacggtacggttacggtaccgaaccgtaaccgtaccttaacgttcgtaaccgg

SEQ ID NO: 145943 - DNA, 674 bp, Homo sapiens
  misc_feature: GYAE6OF01C2QHN.21.4.A04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
tcagtcgtcgctcgcacgaccggtgctcgatttagagtagtgatcaggggagagctgctcagttaggacccagagggaccatggaaccccagcgcagcttctcttcctcctgctactctggctcccaggctcagaaaccaccggagaattgtgttgacgcagtctccaggcaccctgtcttgtctccaggggaangccaccctntcctgcagctccagcctagatanccaganctactacatacgcctggtaccngcagancctggccaggcctccaggttcctcattctatgacctcgggacccacgngggcctagtgccatcccgagacctaggttcaggtcggactaggtgggtccgtgggacaggtcctttcgaaccttntaccgattaccattacgacgtaggactggtacgaccttaggaaacgtacgttttaccggacgtaggtttacgttaacgttttacgtcggtacctaggtaccctaaggttacgtagggttaacgttaccgtaccgtttccgttacgggttcggtttacccgggaccggttaaaaccggggtaacccgtaaagggggttaaactaaaacggggttaacggaaaaccggttaaccgttaggggttaaccgtacggtttaacggaccctaaccggtaccgtttacgttacccgg

SEQ ID NO: 145944 - DNA, 780 bp, Homo sapiens
  misc_feature: GYAE6OF01CA4E5.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagtaaattgtgttgacgcagtctcaggccaccctgttctttgtctccgaaggggaanacgccaccctctcctgctagcctccagccagtaactactaccgagacgtaccttaactacgtaatacgccgttacggtaacccaacggacaacggaaccggtcccgttacgggacccgacggtccctaccccggtaggtttccctactacgtacttacgtcggtaccggtcggtaccccgacggtaccgggtcctacggtcggaccctacgtaccccgaaggaccgttacggttacgacgggttcgggaccggtagggtttcgggtaccggtacgggtaactacgtacctttcgaacgttccgtactacgtacgtattaccgacgtacgtacgtacggacgtcgagtaacgtctttacgacgttaggtttacttaacgttacgttacgtacgacgtaccgttaaggttacggtagggttaaccttccgttaccgttacggtttacggttacccgggttacggtaaccggaaaccggggtaaaccggttaaagggtaacgttaaaaggtaacggtaaaacggttccggttaaggaccgggttacctaccgaaccgttactaggttccgttaacccg

SEQ ID NO: 145945 - DNA, 682 bp, Homo sapiens
  misc_feature: GYAE6OF01AWTFV.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccaggccaccctgtctttgtctccaggggaaancgcccaccctctcctgacacgcctcccggccaagaatactccagacgacctactacatacgcctaggtaccagcagaacgccgtcggccacggcctacccgtacggttccactagttcctacgtcgcgttccgggtacccacggacggggacctacggtcgggacctacgtacccgacgtaccgtacggttacgacggtcggaccgtagggtccgggtacgtaggggactaccggtacttaccgactcgtacctatacgtacgtagaccgagtacgtacgggacgtccgtaggaagtcttacgcgtagtagtacttacgtcgtgagacgtagtagtcgggtacttcctaccttcgtaccggttcggtaccggtaccggtaacgggtaccgtaaaggttacgtaaacggtaacggtaaaccggtaacgttagggtacggtccgtacggtacccgtaagtaccgtttccgtcggtttaaccc

SEQ ID NO: 145946 - DNA, 779 bp, Homo sapiens
  misc_feature: GYAE6OF01CFH2E.21.4.A04.1.454.CMB.1.raw
  modified_base (132)..(132): a, c, t, g, unknown or other
  misc_feature (132)..(132): n is a, c, g, or t
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagaggaaccatggaaaccccagcgcagcttctcttcctcctgctactctggctccaggctnaagaaccacgganaaattgtgttgacgnagtcctcaggcacctntcttgctcgagggaaancgtccaccgttntccgtagcgactctccagcctaagtaatacgtccgaagtacgacctaaactacgagtagtacccgtaggtaaaccgacgtaccgtaaaggaaccgtccggttacggccgtaaaccggtccgtaccccgttacggttaccctcgtaaactacgttaagtccggaccggttaccgggtacccaacgggtaacggcccgtaaacggtcggtacaagtaccccgtaaggaacgtcggttacagggttacgaagtcgggtggtaccgtcgggaatacgtacttcgaaaccttcgtactaactacggtaacgtaacgacgtaacgtaacgtacggtaacgtaccgttaaagtaacggttacgttacccgtaggtaacgttagtttaacctagttaccggtaagtacgagtaacggttaacgtaaacgggttacgttaacctcttaccgggttagttaccgggttaccgggaaacggtaaacgggtacccggtaaaaggtaaacggtaaacgttaacgggaaaccgtaacggttacggtacggtaccgtaacggtaccgaaccgtaacgttacggttaccg

SEQ ID NO: 145947 - DNA, 926 bp, Homo sapiens
  misc_feature: GYAE6OF01BMF1R.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaaattgtgttgacgcagtctccaggccaccctgttctttgtctaccgaggggaaancgcctaccctctccgtgcagcctccgagccaagaatactccgaagacgtactactaacagtacgaccttacggaaccgacgacgaaacgaacggtccgtacggacccgtacggcccttaccccgtacggttccctactactccgtagtccggtaccggtaccggtacccacgggaccggtaccgaacgtcggacctaaccgtacccaacggtaccgttacggtaccgaggtcggtacggtagggtcgggtacgtagggacctaacggtacttaccacgttacctactaacgttacctaagttaacgacgttaacggtacggttacgggaacttacggtaaacggttaaacgttcggttaccgtaacggtttaacgtttacggttttaaccggtttacgttacggttaaccggtaactacgggttaaacggtttaacgggtttaaccggggtttaaacccgtttaccgttaaccccgggttttacggtttacccgggggtttacccgggtttaaacccggggggaaaccccggttaaaaaccgggggggtaaaaaacccgtttaaaacggggggtaaaaaaccgtttaaaaaccgggttaaaacggggtaaaaaacccgggtttaaccggttaccgggtaaacccggggttaaaccggttacccggttaaaacccggttaaaccccgtttaccgggtttacccggtttttaaacccccggg

SEQ ID NO: 145948 - DNA, 780 bp, Homo sapiens
  misc_feature: GYAE6OF01AZUKJ.21.4.A04.1.454.CMB.1.raw
tcagtcgtcgctcgcacgaccggtgctcgatttagagtagtgatcaggggagctctgagagcggagccccagcccccagaattcccaggtgttttcatttggtgatcagcactgaacacagaggactcaccatggtagtttgggctgagtcgttggttttccttgttgttattttacgaaggtgtccgtagtgtgaggtgcagtcgtggtggagtacggtggggagtacgttcggtccgagtccgtgggacggtccgtagacgtacctcgtccgtgtcgccgtcgtccctgtgacctacttccgtaaccttcgacgtacgaacccacaacgtagtcggtaccgttccgggtcccgaccgacgggtccgtaaccgggaaggggtaacgggtcggtacggggtagggttaccggggtaccggtaccggttaagttaaaccggaaaggtaaacgtaacgtaaacgttacgttaaccgtaacgtaaccgtaaaggtaaccgttccggggacgtcggttacgtaacgggtaagtaaacgggttaacgtaaccgtaacccgtatacgaacgtaaggaataagtacgttaaacgtaacgtaacgtaaaccgtcgtaacgttacgtactataaccgaacgtaagaacgtaccgaacggtaacccgaaacggtaacgaaccggtaccgtacgtaaccgttagtttagtaacggtttaggaacgttaaagggtaacgtaaaggttacggtagtaggttgggtaacggttagacggttagtacggtaaccg

SEQ ID NO: 145949 - DNA, 1085 bp, Homo sapiens
  misc_feature: GYAE6OF01AP497.21.4.A04.1.454.CMB.1.raw
tcagtcgtcgctcgcacgaccggtgctcgatttagagtagtgatcgaggggagctctgagagcggagccccagccccagaattcccaggtgttttcatttggtgatcagctactgaacacagaggactcaccatggtagtttgggctgagtcgttgggttttccttgttgttattttacaaggtgtcagtgtgaggtgcagtcgtggtcggagtcggtggggatacgttggtccagtccgtagggacggtccctagacgtcttccgtccgtgtcgcagtaccctctcggctaacttcctaaccctttgacggttaccgacccgaacaaaccgtagtacggggtaccgttcgggggttacccccgaccggaaacggggttcctacccgggggaacggggggtaaacgggggttccgggtacggggtaaacggggtttcccggggggttacccgggtaaccccgggttttaaattaaaccggggaaaaacgggtttaaccggtaacccggtttaaaaaccccggtaaggtttttaaacccaaacgggttaaacccgtaaacgggttaacccgttaaaaccgggggtcccgggttaacccgtttacgggttacgggtaaaaggggtaaaacggggttaaccgggttcccctaaaccccgtaaggtttacccgttaaaaccgggaaagggttaaacgttacggttaacggttaaaccgtttaaaccggaaaaaccggttaccgtttaacccgtaaacctttttcgggtaaaccttttcccgaaacgggttaaaccgtaaaaccggtttaaccgggaaaaccccgtttaacgggtaaaacccccgggttaaaaccgggaaaaaacccggggttaccggaacccgggttaaaacccgggttcccggtttaaaaggttttaccggttttaaaaggtttacccgggggtaaaaggggttaaaaccggttaaaaaaccggtaaaaaaccggggggtttacgggttagggggttaaaaacgggtttttcggggggtaccggggttttaaacggggtaaaccgggtttccccggtttagggggtaaaaccccccgg

SEQ ID NO: 145950 - DNA, 827 bp, Homo sapiens
  misc_feature: GYAE6OF01BTXAJ.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctccttcctcctgctactctggcctcccaggctacaagaaaccaccggagtaaattggtgttgacgcagtcctaccgaggccacccttgttctttcgtcctaccggaaggggaaacacgccctacccgtcctcctgcacgcctaccgacgaccgtaagtaactactacccgaagaccgtaccttaaccgtaactacgtaacgacccgttacggtaacccgaggtaccgaacggtaaccgtcccgtacggacccgtacggtccccttaccccgtacggtttcctacgtacttactacgtcggtccggtaccgggtaacccgaccggaccgggtaccaccgtcggacctaccgtacccgagtaccggtaagtccgaggtcggtacgtagggtcggtacggtacggtaactaccggttaccttacccgtaccgttaccgttaactacttacgtaacgttacggaccgtacggtacggttacggaacgtaccggtaaggtaccgtttagtaccgtagttacgttacgtttacttaccgttagtacgaacgttacgtaaagttacggtaggttaaccgtttccctacggtttcggtaccggttaacccgggttaccggaaacccgggttaagggaaaccggttaaacgggtaaagtaaaccggttaaccgtaaacggttacgggtaggttaccgtacgtaccgaaaccgttctccggtttaacgttccgg

SEQ ID NO: 145951 - DNA, 822 bp, Homo sapiens
  misc_feature: GYAE6OF01AZIT6.21.4.A04.1.454.CMB.1.raw
  modified_base (788)..(788): a, c, t, g, unknown or other
  misc_feature (788)..(788): n is a, c, g, or t
  modified_base (811)..(811): a, c, t, g, unknown or other
  misc_feature (811)..(811): n is a, c, g, or t
  modified_base (818)..(818): a, c, t, g, unknown or other
  misc_feature (818)..(818): n is a, c, g, or t
tcagtcgtcgctcgcacgaccggtgctcgatttagagtagtgatcagggggagagctgctcagttaggacccaggagggaaccatggaaaccccagcgcagtcttctccttcctcctgtctactctcgacctcccgaggtcctacaacggaaacccgaccgggaagtaaattggttgttgacgctagtcctaccgacggcctaccgttgttccgtttcgtaccgttaccggaagggggaaacgaccgcccccgtacccttccgtcccgtcggacctaccgtaccgtaccgaacgtacccgaagtaacttactaccggaagaccgtacctaacgtacgataccggtccgtacggtacaggacacgacgtccgtacggaccgacgtcccgtaccgtacggttccctactacgtcgttacgtccgtccggtaccggtacccaccggtacggacctcgggtacgacctacgtacccgtaacggtacggttcggtacggtacggtacggtacggtacggggtccggttacgggacgggtaacgtaccgttaccttaccgtacgttaccgtacgttaaccgtacttaacggtacgacgtaagggtaccgtacgggaccgttacgaacggttaaccggttcgttacggtactagggttacgtttacttacgtaggtaacccgaggtttacgaaacgttacggttaggtacccgtttaccgccgtttagggtcccgttaacgggtaccgggaacggtaaaccggtacgtaaaggaccggtaaacgtaacgtacggngtaccgtcgtaacgcctaactcnccggttntacg

SEQ ID NO: 145952 - DNA, 823 bp, Homo sapiens
  misc_feature: GYAE6OF01D4I6A.21.4.A04.1.454.CMB.1.raw
  modified_base (120)..(120): a, c, t, g, unknown or other
  misc_feature (120)..(120): n is a, c, g, or t
  modified_base (159)..(159): a, c, t, g, unknown or other
  misc_feature (159)..(159): n is a, c, g, or t
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
tcagtcgtcgctcgcacgaccggtgctcgatttagagtagtgatcaggggagagctgctcagttaggacccagagggaaccatggaaaccccagcgcagcttctcttcctctgcctactntgctccaggctcagaaccacggagtaattgtgttgacgnagtctcagcacctgtcttgctcgagggaangccacctcgctgcagctccgagcaagaatactccganacgtctaactacagtacgaccttacggtaaccaagacaaggacgtccgtacggaccacggtcctacccgtacggtttccctacgtaacttcttaaggttcggccggttaccggtaccccctaaggaccgggtaccctacggttacggacctaaccgtacccgaacgtaaccggttacggttaccgtaacggtcgggaagttacgggggtttcgggaacccggtttacggggaaaccgtttaccgggtacctttaaccgttaaccgtccgttaacgtaacttacgttaaacgtttacggaccgtaacggtaacgttacgggtaaccgttaccggttaaaaggtaacggtttaccgttttaccgggaacgttaacggtttacgtttaaccggttacgttacggttaccgaacggtaaccgttaaggttaacgttacgggtaactttaccgtacccgtttaccgggtacgtttccgggttaacccgggtaaggtaaaccccgggtaaacgtaaacgggtaacggttaaacgtaacgggtaaacggtaaccggttcggtaccgggtacttaaccggaccctaacttccgtacggttacccg

SEQ ID NO: 145953 - DNA, 913 bp, Homo sapiens
  misc_feature: GYAE6OF01CGC3O.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctctgctactctcggctcccaggctcaacgaaaccaccggagtaaattgtgttacgacgcgtagttccgtccgacgctacccgttgttccttttcggtcctaccggaacggggggaaaacgaccgtcccctaaccccgttccttccgtcggccgaacggccttacccgaacgcccgaaagtaacttaacctaccgacggtaacgtacccttaaactaacctaacgtacggttacccggttaccggtaacccaacggtaccggaaaacggaaaccggttacccggtccggggtaacccggaaccgggttcccctacccccggttaaccgggttttccctacgtaacgtttcgtacgttccggacccggttccgggaccccgtacggaccgggtccgaccgtacggactaccgtacccggaagttaccgttacggtacggtacgggtacgggtaccggttacggggttcgggtacggtaaccggggtaactaccggttaaccttccgttaccgtccgtacgttaacgtaccttaacgttacggtacggtaaccgttcggtaacggtacgtaccggttaaagtacgtttaccggtttacgtacggttacgtttaacgtttaaccgttcgtacgttacgaaccgttaacgtagggttaacgttacgggtacctttaccggaccgtttgttacccgggtacgggttccccggtaaacgggtaacgaacgggtaaaagttaaacggtaaacggttaaacggtacggtaacttagggtcgtactaccggaccttaactcgttcgttaaccg

SEQ ID NO: 145954 - DNA, 801 bp, Homo sapiens
  misc_feature: GYAE6OF01AFR50.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttggctgagcgtgggttttccttgttgttatttacgaaggtgtccagtgtgaggtgcagcgtggtggagtcgtggggagtacgttggtccagccgtggacggtccctgacgtacctcctccgtgtcgcacgtcctctgcctattccgtaccttcgacgtacgacccaacaactagtcgggacgtccgggtacccgccgacggtccgtaccggagggggtaacggggtcgtaggggtacgggttacggggttccgggtaccgttaaagttaaccggaaacggaaacgtaccttaaagtacgttaacgaacgtaacgaaggtaacgtccggacgtcggttcgtaggtaacggaaacgggttacggttaccaaccgtacgttacctaacggaaaaggtacgtaagtacgtaaacctttaacggaaaacgtaaccttacgtaacgttcgtaattccgaataaccgtaaattaccgggaaacccgtaggtaaccccgtaaacgggaaaacccgggacggtaacccgtaaccggggttaccttacgggtttaaacgttttacgggttagggttaaccgggttaaaacgaaaacgggtaaagggttacggggttaaggtacgggtttagggttacggggttaaggtaccggttcggttagggtaacccgg

SEQ ID NO: 145955 - DNA, 861 bp, Homo sapiens
  misc_feature: GYAE6OF01AZ79G.21.4.A04.1.454.CMB.1.raw
  modified_base (830)..(830): a, c, t, g, unknown or other
  misc_feature (830)..(830): n is a, c, g, or t
tcagtcgtcgctcgcacgaccggtgctcgatttagagtagtgatcagggggagagctgctcagttaggacccagagggaaccataggaaaccccagcgcagcttctcttcctcctgctactctggcctcccaggctacaacgaaccaccggataattgtgttgaccgactacgttcctccgacggcctacccgttgttcctttcgtccgtaccggaaagggggaaactcctaccccgtaccccttccttacccgttcgaccgacgtccctacccgacggaccgtaaagtaacttacctaaccgaagtacgtaccttaactacacgtaccgtccgttaacgtaaccagacggaaaggtaccgtcccggtaggacccgacggtccccttacccggttacggttccctacttacttccgttacgtcgggtccgggtttacccgggacccctaacggggaccccggtacctacggttaccgacctacccgtacggaacggtacgtcgggttaacgcgggtcgggacggtagggttccgggtcggaaccgggtactaccgtaccttacggtactccgtaacacttaccgtagtaactcggtacgtacggtacggtacgtaccggtaagttaccggtcgtttaccggaacgtttagttacttaaccgggttacgttacagggtaaccgttagtaacggtttacggttaacggttacccttaccggttacccgttacgggttttacgggaccggttaaccgggtaaaccgggaccggttaaaacgggtaagtaaccgttaaacgggtaaacgacccgggtttaaagcgggttaaccncgttactacccgtacggttctccggttaccc

SEQ ID NO: 145956 - DNA, 858 bp, Homo sapiens
  misc_feature: GYAE6OF01BSEZP.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgtttattttacgaaggtgtccagtgtgaggtgcgagctgggtggtagtcggtgggggatacgtttcggtccacgtccgtggggaccggtccctaggacgtaccttcctccgtgtcgccacgtccctcgtcgacctacttaccaaccctttgaacgttaccgaaccctaaacaaacgtacggttacgggtaccggttaccgggggtccccgaaccggtaacgggccgttaacccgggaaggggggtaacggggtcgtagggggtaacgggttccggggggtaccgttaccggttaaagttaaaccggaaacgggtaaacgtaaccgttaaacgtaacggtttaaaccaaagtaaccgtaaaggtaacggtaccgggaccgttcggtagttaacggtaagggtaaacgggtacggttaccaacccgttactaccgtaagaaacggagttacgtaaagtacgttaaaccgtaaaaggtaccttcgtaacttaggttaacttaccgagtaacgtaaaactaccggtaaacaacccggggtaaccgttaaaacgggaaaacccgggcgtaaaccccgggacggggttaccttttaaggttaaacgttttacgttacgggtaaaacggtagtaaaaacgggtaaagtacggggtagttaacgggttggtaacggggttagaccggtttgcggttaacg

SEQ ID NO: 145957 - DNA, 835 bp, Homo sapiens
  misc_feature: GYAE6OF01BNX0F.21.4.A04.1.454.CMB.1.raw
  modified_base (282)..(282): a, c, t, g, unknown or other
  misc_feature (282)..(282): n is a, c, g, or t
  modified_base (812)..(812): a, c, t, g, unknown or other
  misc_feature (812)..(812): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcacatggtagtttgggctgagtcgttcgggttttccttgttgtttattttacgaaggtgtccagtgtgaggtgcagcgtgggtggagtcggtagggggatacgttggtaccaggccgtgggacgggtccctaggacgtaccttcgtccgtggtcncgtacgtccctgtcgtctacttcctaccgttcacggtacaaccaactaacgtagtacggtaacggttccgggcccgaccgacgggtcctaccgggaaggggggtacgggcggttagggtacgggttcggggtacccggtaccgttaaggtaaaccgaaaggtaaaccgtactaaaacggtacgttaacgaacgtaaacggtaacgacgtaccgggcgttaccggtagtagggtaaggtaaacggggttaacgtaccaaccgttacgtaccgtaaacggaaacggtataacgtaaggttaaccttaacgaaaaccggtttaacctaccgttaacgttcgtaactcccgttaactaaacgaagtaaaccgtaaccggaaccgtaaaccggtaaaaccgaaaaccggggacccgtacggaacccgggtttcgtaaagttttaccgggttttaaggtccgggttaaaggaaagttaaaacggtaaaacgggttgttaaacggttaaggtttcggggtttaggggtttaaagggntttaaccgggtgttaaacccggg

SEQ ID NO: 145958 - DNA, 846 bp, Homo sapiens
  misc_feature: GYAE6OF01BUB6J.21.4.A04.1.454.CMB.1.raw
  modified_base (648)..(648): a, c, t, g, unknown or other
  misc_feature (648)..(648): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaaattgtgttgacgcagtctccaggccacccttgttctttgtctccgaaggggaacgacgccaccctctcctgcagcctccgacgaccaagaactactccgaagacgtacttaaccgtactaagttacgccgttaacggtaaccacgacgtaaacggaaccggtccgtacgggacccgacgggtcccttaccccggtacgggtttccctactacgttaccgttacgtcggtaccggtttaccggggtaccccaacgggaacccggggtacccgtacggttaccgggaccctaacccttacccggaacgtaaccgttacgggtttaccgaagggttcgggacccggtagggttacggggtcggtaaccgggggtaactaaccggtacgtttaccctacctaccgtactataccgttagttacgacgacgtacggtacggcgaccgttaggtaacgttactttacggacgttaggttaacgttactttacggtacgtacncggtataacggtttacggtaggttaaccgttaccgtcccgttaggttaccggtttcccggtacgggtaaaccccggtaacggtaaaaccgggtaaagggttaaaccggtaaaaccggtaacggtaaaaaccgggttcggttaacggttaccggggtacctaaccggtaaccgaacccggtttagttcccgtttaacgg

SEQ ID NO: 145959 - DNA, 801 bp, Homo sapiens
  misc_feature: GYAE6OF01AV06W.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgtctttgtctccgagggaaanctccaccctctcctgcacgctccagaccaagaactactaccagacgctactacagtacgcccgttaggtaaccaggaccaaggaacgtcccgttacgggcccgtaggtccccgtaccccgtacggtttacccctacgtaaccttaccgttagttccggccggttacccgggtaaccccgaaccgggtaacccggggtaccccgtaaccgggtccgggtaacccctaacccggtaaccccgtaacgggtaaccggtaaccggttaccggaggggttacggaccggttaacggggtttacgggtttccgggtaacgggtaacccgtaacggtaaccctttccgtacccgttacctaccgttaaccgttactaacggttaacgacctaacgggtacgtacgggaaccgttccggttaaagtaaccggttacgtttccggaacgttacggtttacgttacgtttacctcgtaccgtacgtacgtagtacggtagttactacgtaccgttgtaccgtcggtaccggaccgtaaacggtacgtaacgggtaaagtaatacggaaacgtacgtaggtacgtcctagtacctaccgtagttccgttccg

SEQ ID NO: 145960 - DNA, 864 bp, Homo sapiens
  misc_feature: GYAE6OF01CH8D6.21.4.A04.1.454.CMB.1.raw
  modified_base (116)..(116): a, c, t, g, unknown or other
  misc_feature (116)..(116): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcagggggagagctgctcagttaggacccagaggggaaccatggaaaccccagcgcagcttctcttcctcctnctactctggctcccaggctcacgaaaccacggagaaattgtgttgacgcagtcctcaggccaccctgttctttgtctaccgaagggggaaancgcccacccttctccgtcgcgacgtcctccgaagtacccgaaagtaaactactaccgaaggacgtaccttaaacctacgtaattacggtccgttacgggtaacccaggacgaaacggaaccggtcccgtcgggacccgtaacgggacccttacccggtaaccggtttccctacgtacctttacgttacgtccgggtcccggttaccggggaccccaacgggtacccggggtacccctaacggttccgggcccttaaccgtaccccgtaaagggtaaccggttacgggttaccggtaaggggttccgggaaccgggttcggggtttcggggttaccggtaagggggtaaacgaacccgggtttaccgtttaccaaccgtttaccggttactacgttaccgtaaggttacggacgtaacgggtaacggtcggtacggtaacttaacgggtacgtttacgtaccggtagtagtttacgttaccttacggtacgtacgtagtcgttaacggtaggtacggttacgttacctacgttcggttcggtaccggtacggtaacccggggtaaagtaaaccgggtaagtaaaggtaaaccggtaacggtaaacggtacgttaagggtccgtaacgtacccgagtttaacctcggttcgttacccg

SEQ ID NO: 145961 - DNA, 767 bp, Homo sapiens
  misc_feature: GYAE6OF01EAJ8H.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagaaattgtgttgacgcagtctccaggcctacctgttctttgtctaccgaaggggaancgcccaccctctcctgcacgcctccacgacctaagaatactccgaagacgtaccttaactacaacgttacggccttacgggtaaccaaggaccaaggaaccgtccgtcggacccgtacgggtcccttaccccggtaaggttttcccctactacgtttaccgttaacgtccgggtacccggtttacccggggtaccccaacgggtaccggggtccctaacggttcggacctaacccgtaccgaacgtaacgtcggttacgaagggtcggacgtgggtttcgggtcgtaacggggactacggtccttacaccttctactagttacctagtaccgacgtaacgtaccgggttggaaccgtcgttaaggtaaacgttcgtttacgaagttacggtttactttaacgtttacggttcgtagtaacgtacggttaaggttaggtaacggttacgttaccctacgttcgttacggttcgggaaccgtaccgggtaaacggaacgtaaggttaaagaacgtaacggtaaacgtcgtaggcgtacgttaccacgtacttgttcgttaccg

SEQ ID NO: 145962 - DNA, 869 bp, Homo sapiens
  misc_feature: GYAE6OF01C3X08.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaacgaaaccaccggagtaaattgtgttgacgcagtcctccgaggcctacccgttgttcttttcgtccgtaccggaagggggaaagacgcccctacccttcctcctgcacgcctccacgaccaagaactactccgagacgtaccttaactactacgtacgtcctaggtaaccagaccgaaggaaccgtcccggtacgggaccgtaccgggtcccttaccccggtacggttttccctactaacttcttacggtcggtaccggttacccggggtacccaacgggtaccgggtaccctaacggtcggacctaccgtacccgaacgtaccgtaggtttacgaggttcggacgttaggggtttacgggtccggtacgggtaactacggttacccttaccgtaacgtttcctacgttaattacccgttaagttaccgggaacgtaacggtaccggttaggaccggttaaccgttaggtaaaccggttttccgtttaacggtacgtttaacgggttttaacgtttaaccgttttaacgggcgttaaccggtacggttaaacggttaacggtttaacgggtttaccgggttaaccgttttcccctaaccgggtttcggtttaccgggttacccgggtaaacggaaccgggtaaaaccgggtaacgtaaaagggttaacgtaaaacgtaaccgggtaaacgtagttcgggtacgtaccgtacgacctttacgtgtttctacccg

SEQ ID NO: 145963 - DNA, 691 bp, Homo sapiens
  misc_feature: GYAE6OF01DZ6X8.21.4.A04.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggtttttccttgttgttattttacaaggtntccagtgtgaggtgcagctgggtgagtcgtgggggatacttggtccagccgtggagggtcccctggagactctcctggtgcacgcctctgtctattccaccttcaagtcgaccaacaacagtcggacgttcggggtcccaccgacgggccttaccgaagggggaacgggcgttagggacgggttcggggtacggaccgttaagtaacgaaaggtaaacgactaaacgagttacaacgtaacagaactcgggacgtcgtacgtagtacggaaaagggtcgttaccgaactagtctaagaaagtatatagattacgaaaagacctactacttgtaacgttactagaactaaaagtcaaaccgacgtaaccgtaacggaaaaccggagggtaaaccgtaaccgggtccgttaagtttaacgtttaggttacggtaaagggtaaacgtaaacgtaaaaagggaggttaggtaacgttagggtttaccgggtaagtacggtccgttaggtacccg

SEQ ID NO: 145964 - DNA, 859 bp, Homo sapiens
  misc_feature: GYAE6OF01BTIXI.21.4.A04.1.454.CMB.1.raw
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaaccggagaaattgtgttgacgcagtctccaggcaccctgtctttgctcgaggggaaanagccaccctctcctncagctccagccagaatataccagatctactacatagaccgtgtaaccagcagacgccgtggacaggctaccaggttcctgactctatcgcgtaggtacccagacgggcccaacgtggcccaatcccgacgtacgtacggttacgacggttacgggacgtaacgggttccgggttaaccggtacgggggtaacctaacgggtaacccctttttacccaaaccgtttcccgttacccgttaacggtttaccttaaaacgttttaaccgggaaccggttaaagggtaaacccgtttgggggtaaacccgtaacccggtttaaacggggtaaaacgtttaccggttttaacccggtaacggtaaacggtttttaccgttaaaagttttttacccgtaaggggtttaccctaaacgggttaacccgttaaggtttaaacggttaaacccggggtttaaacgtttacccgttaaccgttaccggtttacggttaccccgggggtttaacgaaaccccggggtaaaagggttaaaccccggtaaaaaggggttaaaccgtaaaaagggttaaacgtaaaaaccccgggttaacggtttaagggaccggttacggtaaccggaacttacccggaacttcggtttaacccgg

SEQ ID NO: 145965 - DNA, 789 bp, Homo sapiens
  misc_feature: GYAE6OF01BXZ46.21.4.A04.1.454.CMB.1.raw
  modified_base (200)..(200): a, c, t, g, unknown or other
  misc_feature (200)..(200): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggctacctgtctttgctccgaaggggaancgccacccttctacctgccagcctccagaccaagtaaattactaccaaggacgtactaacctacacttacgccgttcgggtaaaccaaggaccgaaaggaaccggcccgtagggcccgtaacggggtcccttacccccgtaagggtttcccctacgtaaacttcctttaagttccgggtaccggtttacccggggtaccccaagggaccggggtaccctaacggtcggaacctaacccgtcccgaaggttaaccgtacggttacgaaggtcggacgtagggttcgggtacgtagggaacctagtccttacgtaccctanacgtaatacgtaacttacgacgacggtaacgtacggtacgtacgtaaggtaacgttacgtttaccggtaacgttaggtttacttaacgttacttacggtaacgtacggtaacgtaaggttaaggtaagtaacgttacctacgttacggttcggttaccgggtaccggaaaccgggtaaacgggtaaacgtaaagggtaaacgtaaacgggtaaggtaaaaaccggtacgtaaggtcggtaaccacgtaaccaacgttcgtacgttaaccg

SEQ ID NO: 145966 - DNA, 768 bp, Homo sapiens
  misc_feature: GYAE6OF01DR8DY.21.4.A04.1.454.CMB.1.raw
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
  modified_base (723)..(723): a, c, t, g, unknown or other
  misc_feature (723)..(723): n is a, c, g, or t
tcagtcgtcgctcgcacgaccggtgctcgatttagagtagtgatcaggggagctctgagagcggagccccagccccagaacttcccaggttgtttttcattttggtgatcagcactgaacacagaggacctcaccagtgggtagtttgggctggagtcgtttgggtttttccttgtttgttttaattttacgaaggttctccaggtgtgaggtcgcaggtcgttgggtggaggttcggtagggggaactcgtttcgggtacccaggtcccggtaggggtaccgggttccctggaacgtacccttctccgtagtggcctacgtcctntcgctacttcctactnacgtacacacaacgtgtcggactcgggcccgacgacggccgtaccgggaagggacgggtcgtagggtacgggttcgggtaccggtacgttaacgtaaaggaaacggaaactacgtaaacgtacgttaacgaagttaacgagtaacgtcggctacgtacgtggtaaacgggaaaggtacgttaccaacgtacgttacaacgaaagtagtaacgtagtaacgttaaacaaacgtaccttacgtagttacgttaacgtgtaacgaacgtaaacgtacggaaaccacggtaacctaaaccggggaaaccgaccggacgtaaccgggttacttaaggttaaccgtttaggttacgggtaaacgggttaaacgaaaggtaaacgggngttagggtaacggttgggtagggtttaggtcgtagttcggaacgg

SEQ ID NO: 145967 - DNA, 927 bp, Homo sapiens
  misc_feature: GYAE6OF01CX7O1.21.4.A04.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccagtggtagtttggctgagtcgtttgggtttttccttgtttgtttaattttacgaaggttcgtcaggttgtggaggtncgaggtcgtggggtaggacggttcgggtagggggacgttaccgtttcgggtacccgacggtcccgttagggggacggggttcccctggaacgtacccttcctccgtggtcgcgtaccgtccttcgtcgaccttacttacccgtaccgttacgaacggtaccgaaaccctaacgaaacgttagggtaccggggtaaccggttccgggggtaccccaccgggtaaccgggtacccggttacccggggaaaggggggtaaccggggttccggtacgggggtacggggttccgggggtacccggggttaaccgttaaaagtaaaccggaaagggtaaaacgtaccgttaaaacgtaacgttaacgaaggtaaaccgaaggtaaaccgggtcgggtaccgtaccggttagttacgggtaaacgggtaaagggttaaccgttacccgactaacgtacgtaaacgaaggtactaagttacctaagttaaccgaaacgtaccgtactaacgttagttaacgtcgtaacgtaacgtaaacgtaacggaaaccgtaacggtaaccgtaaaaccgggaaaacccggtacgggtaccggtaccgggttacggtttaaggtttaaacgttagggtttacggaaacgggtaaaggaaaacggtaaagggttacgggttaaggttagggttacggggtttaagggtaacggttcggtaggttcccgggtaaacg

SEQ ID NO: 145968 - DNA, 720 bp, Homo sapiens
  misc_feature: GYAE6OF01CGFD4.21.4.A04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (480)..(480): a, c, t, g, unknown or other
  misc_feature (480)..(480): n is a, c, g, or t
  modified_base (488)..(488): a, c, t, g, unknown or other
  misc_feature (488)..(488): n is a, c, g, or t
  modified_base (536)..(536): a, c, t, g, unknown or other
  misc_feature (536)..(536): n is a, c, g, or t
  modified_base (583)..(583): a, c, t, g, unknown or other
  misc_feature (583)..(583): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggcctcccaggctcaacgaaaccaccggagaaacttgtgttgacgcagtctccaggccacctgtctttgctaccgagggaancgccacctnctagcagctccagtccagacttacaccaaganctaactacgagtacgccgtaggtaaccagccgaagaaccggccgtcggaccgaaggtcccctacccggtaacggttcccagtaacttccgttatcccggtccgttccggggaacccaaggaccggggtacccctaacgggtcggaccttactaccccggaaagtacccgttaaggtccaagggtcggacgtaggtccggtacgtaggaacctagttacctacgaccttagaccgttnaacgttanacggaccgtagtaccggtagacgtcgtaacgttaggtactttacgggntacggttatacgttacgtgtaaccaggctaaggttacgaccgtttanacccttgtacgtaccggttaccgtagggtaacccgtaaaacgggaaccgttaaaagggtaaccgaaaggtaaaccgaacggttaacgttagggaaccggtcttaccggaaaaccgtcttaaaggttccgtttaaccg

SEQ ID NO: 145969 - DNA, 711 bp, Homo sapiens
  misc_feature: GYAE6OF01EGHLB.21.4.A04.1.454.CMB.1.raw
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccacggccacccttgttctttgtctccgaaggggaaagacgccaccctctcctacgcacgcctccagccaagaatactccgaggactcctaactacgtatacgtccgtaggtaccagaccgaagacgccgtaggccacggtcctaccgtacggtttcccanacttctagtcgtccggttcgggtacccaggcgggcctacgtcggacctccgtaccgaggtaaccgtacggttacgnggtaacggcggtaaggtcggggtcgtaggtacccagttaccttccgacttctacgtaacttacgtaagttacgacgtacggtacgtacggtaactcggtagtaaacgttacgttacgtacgttacgttagttaactttaggtacgtacgtaacgtcgttaaggtagttaacggttacttaccgttaacgttcgttacgggttcccggttaacggtaaccggtaaacgggaaacgtaagggttaaacgaaagtaacggtaaacggacgttaaggtcgtacgacgaaccgttacctgttccttacgg

SEQ ID NO: 145970 - DNA, 804 bp, Homo sapiens
  misc_feature: GYAE6OF01DG5HW.21.4.A04.1.454.CMB.1.raw
tcagtcgtcgctcgcacgaccggtgctcgatttagagtagtgatcaggggagagctgctcagttaggacccagagggaaccatacggaaaccccagcgcagtcttctcttcctcctgctactctcggctcccgaggctaccaacgaaacccgaccggaagtaaattgtgttgacgctacgtcctccgacggccctacccgttgttccttttcgtccgtaccgggaaaggggaaacgccgtaccccaccccgttcctcccgtcggacctacgtcccaccgaacgccctaaagtaactactaccgaagtactaccttaactacacgtacgtaccgtacggtaaccacgacgaagaccgtccgtcggaccgtaccggtccctccccggttacggttccctactaattccgtagcggttaccgttccgggaccgaaccgggccgggtacctacggccgtacctacccgtacccgtaaggtaccgtacgggtacgtggtacggacgtagggtcgggtacgacggtactacggttactccgtacttcgtactatacgttaacgtcgacgtacggtacgtacggtacgtacgttaaggtacgtttacgtacgacgtttagttacgtttacttacggtcgtacgtacgtaacgtaggttaaggttacgtaaccgttaccgttaccttcgggttacggttcccgggtaccggtacgggaaaaccgggttacgaaagggtaaacgtaagggtaaacgttaccggacgttacggttacggacttaacgtacccgtaccttcgggttcgttacccg

SEQ ID NO: 145971 - DNA, 647 bp, Homo sapiens
  misc_feature: GYAE6OF01BWNG8.21.4.A04.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctcaggcacctgtctttgctcagggaangccaccctctcctgcagcctcagccagaatnccaganctaactacatacgcctaggaccagcaaggaacgtcctggacccagggtccctaccccgtaggtttcccntaacgttcctagtcgtccgttccgggtaccccaggtcgggccctagtcggccacgtacccgagacttggttcgagttcgggctagggtcgggtctagggaccacggtactttccgacttctcaacttacgtattacgcgtaacgtacgtcggaacgtccgtaggtaaacgttcgtttacgcgttaaggttcttaacgtttaccgtgttaccgagtacgtaagttacgtaggttaacttcgttaccttcgttcgttccggtaccggtacggaacgggtacgtaaaggtacgtaaagtaacggtaacgttagtgggtacgtacgtacggaacctcgtaacgttcttacgg

SEQ ID NO: 145972 - DNA, 764 bp, Homo sapiens
  misc_feature: GYAE6OF01A5JUV.21.4.A04.1.454.CMB.1.raw
  modified_base (517)..(517): a, c, t, g, unknown or other
  misc_feature (517)..(517): n is a, c, g, or t
  modified_base (588)..(588): a, c, t, g, unknown or other
  misc_feature (588)..(588): n is a, c, g, or t
tcagtcgtcgctcgcacgaccggtgctcgatttagagtagtgatcagggggagagctgctcagttaggacccagagggaaccatacggaaaccccagcgcagcttctcttcctctgctactctggctcccaggctcacgaaaccacggaagtaattgtgttgacgctacgtctaccgaggtccacccgtgttctttcgtccgtaccggaaggggaacgacgccctaccctctccgtgcacgtcctacacggaccaagtaactacgtaccgaaggactaccttaactaactaacgttacggtaccgttacggtaaccaacgacaaacggaacgtccgtacggaccgtaacggtccctacccgttacgttttaccactacgttactacgtccggtaccggttcgggaacccaggaccgggacctaacggtcggacctacgtaccgagtacggtacgtacgtacggtacggcggtagggtcgggtacgagggtaacaccggttctaccgtaactccgtanacgtactaacgtacgaccgtagtacgtcggaactcgtacgtagttcgtacgtacgtagttacgttagttanacggacgtagaagttacgtacgaaccgggttacttaccgtaacgtttcggtacggttaccggttaccggaaacggttaaccggtaaacgtaaacgggtaacgttaacggaacggttaaaccggaggttaccgtacggtaccgttaccgaacttaaccgttcgtttccgttaaccgg

SEQ ID NO: 145973 - DNA, 563 bp, Homo sapiens
  misc_feature: GYAE6OF01D3AQ7.21.4.A04.1.454.CMB.1.raw
  modified_base (215)..(215): a, c, t, g, unknown or other
  misc_feature (215)..(215): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcagctggtggagtcgtggggganacttggtccagcctggacggtccctgagactctcctgtgcagtcctctgctattccgaccttcagtcgaccacaacatggactgggtccgccaggcctcgagggaagggctaggagtgggtcgcgtatacgaaggaanctaanagttanagtacagaatacggngacgtcgtagagaaggaggttacaacccgaatcgtacaagactaagtagattacaaaagactctaactgtactgtagactaaagtagaactagccctaagaaacccgaggaacnccggacgttntattacgtagtacggtaagaacgtaaagcgtagaagttggtaggttaggtgtctggtacg

SEQ ID NO: 145974 - DNA, 811 bp, Homo sapiens
  misc_feature: GYAE6OF01BCHK1.21.4.A04.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatcggaaaccccagcgcagcttctcttcctcctgctactctggctcccaggctcagaaaccacggaagtaaattgtgtgacgcagtctccgacggcctacccttgttctttgtctaccggaaggggaaacncgccctaccctctacctgccacgtcctacacgaccaagtaaactactaccaaggtacgtacctaactaacgtaagtaccgtaccgttacggaaaccgaggaccgaaaggtaaccgccgtacgggacccgtaacggtccccgttaccccggtaacggtttccctaccgtaacgtacgttaacggtcgtaacccggtccggggtaaccccacggtaccggaccctaacggttccggacctaaccggtaccgacgtaaccgttacggtacgaggtacggtacgtacgggtacgggttaccgaacgggtactacgtacttaccgacgttacctacttaacgtaacgttagttaaccggactaaccgggtaacttcgggaacttaccggaagttaaacgtcgtttacgacggttagttaacgtttaacgtacggttgtaaccgtaggaacgtttaaggttacggttaacgggtacctttaaccgtcgttaacggttcggtaccgggttacggaaaccgaaacggggttaacaaaacggtaacggaagttaaacggaaacggttacgtcgtacgtacgtacccaagtaccttcggttgttaaccg

SEQ ID NO: 145975 - DNA, 790 bp, Homo sapiens
  misc_feature: GYAE6OF01AGNOX.21.4.A04.1.454.CMB.1.raw
  modified_base (194)..(194): a, c, t, g, unknown or other
  misc_feature (194)..(194): n is a, c, g, or t
  modified_base (771)..(771): a, c, t, g, unknown or other
  misc_feature (771)..(771): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccacggagaaattgtgttgacgcagtctcagccacctgtctttgctcgaggggaancgcccaccgtctcctgcagcctcagccaagaactactcagtacgcttaactacatacgccgtaggtaccagcaaggacgccgtaggccagggtccctacccgtagtttccctagtacttccgttaagtcggtacccggttaccggggttaccccaaacgggtcccgggaccccttaacgggtccggtacctaacccgtaccccgaaagggtaccgttacgggtttaccgaggggtttcggaccggttaagggtttcggggtaccgtacggggtaactaacccgggttacctttacccggaccgttacgtactacggtacttaacgtacggtaccgtacggtacgttacggacgtacgttacgggtaaaccgtttcgttaccggtagttacggtttacgttaacgttacgtcgacgttaacgtacgttaaggttacgtaacgggttacgttaccctacggttacgtccggttaccggttacggaacccggtaaagggtaacccgttaaagggtaaaccgtaaacgggtttaacgaaaccggttaccggtttaacggtcccgtaccgttacggtaaccncttaccgttcggttacccg

SEQ ID NO: 145976 - DNA, 720 bp, Homo sapiens
  misc_feature: GYAE6OF01E0NZJ.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcagggggagagctgctcagttaggacccagagggaaccatggaaacccccagcgcagcttctcttcctcctgctactctggctcccaggctcagaaaccgaccggagaaattgtgttgacgcagtctccaggcaccctgttctttgtctcgaaggggaaanacgcccaccctctcctgcagctccgagccagtaatactccgagagacctactacgatacgtccgtaggtacccagtaccgaagaacggtccgtacggcccgtaacggtccctaccccgtaacggtttcccctactacgttctaacgttcggaccggttaccgggtacccacgtacgggccctaagggtcggacctaccgtacccgagtaccgtaaggttccgaggtgggacgtagggttcgggtaccgaggggaactaacggtacctttcgaaccttcgtaaccgtattacgtaacgttacgacgtacggtaccgtaggtaccgtaacggtgtaaacgttacgtttaccggacgttagttacgtttacgttacgtgtaccgagtacgtaggtacgtaggtaaccttacctacgttcgtacggttaccgacggtaccggtaaacggtaccgtaaaggttacgaaagtacggtaaacgtacgtaggtacgtaccgtacgtacccactagtcgttacg

SEQ ID NO: 145977 - DNA, 657 bp, Homo sapiens
  misc_feature: GYAE6OF01DPHRJ.21.4.A04.1.454.CMB.1.raw
  modified_base (162)..(162): a, c, t, g, unknown or other
  misc_feature (162)..(162): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttcttgttnttatttacaggtgtccagtgtgaggtgcagctggtggagtcgtgggggagacttggtccagcctggagggtccctggagactcgtcctgtcgcagcctngcattcaccttnagtcgaccacanactggactgggtccnccgaggcctacgagggagggctgggacgtgggcggaccgtaagtaccgaaggaagactaacgagttacaaggtacaagtaagacggtcgcgtcgtggtaagaagggtaacgttcaccgtaatacgtacaaaggacgtaataggtaaacttacgaaaacgtaacgtacgtaacttacggttactacgtacgaataaaacgttaggaaactaacggtaccgttaaaccggaaaacccggtaacgggaccaacggggtccgtttaaggttaaacgtttagttaagggtaacggtaagaaaaccggtaaaaggtacgggtaagtacggttagggttgggtaggttaggtcgttgggtaacg

SEQ ID NO: 145978 - DNA, 900 bp, Homo sapiens
  misc_feature: GYAE6OF01CJPXN.21.4.A04.1.454.CMB.1.raw
  modified_base (886)..(886): a, c, t, g, unknown or other
  misc_feature (886)..(886): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactcgtaggcctcccgaggtcctacgaacgaaacccgaccgggaagtaaaagtttggtaggtttacggaaccggtctaaggttcccttaccgacgggaccctaccccgttggtttcccttttggtcccgtacccgggaagggggtaaacgccgtacccctacccgttcctccgtcgacgacggtaccctccgaagacccgtaagtaactacgtacccgaaggacgtacctaacctactaacggtacgtccggttaacggtaaccgacgaccgaacggtaacgtcccggtacggaccgtacggtacccgtccccgttaacggttccctacgtacgttccttacgtccggtccgtaccggtacccgacggcggtaccctacggttcggacctaccgtacccgtagaaccggttacgttacggacgggttaccggacggttagggttccggggttagaccgggtaactaccggttaccttaccggtacttaccgtacgttactacgtttaacggttaacgaccgttaacggacccggtaggtaccgttaccgttaagggttaacggttaccgtttaccggtaacgtttaggtttaccgttaaccgtttacgtagtaaccgtgttaacggttaaggtaccggtttaacgggttaccttaccgttaacgtttccgggttaccggtaccgggttaccggaaaccggtacgggtaaaccgtaagggtaacgtaaaggtacggtaaaccgttagggtacgtacggtacacggtaacncgttgtcgttaccg

SEQ ID NO: 145979 - DNA, 745 bp, Homo sapiens
  misc_feature: GYAE6OF01A1AJY.21.4.A04.1.454.CMB.1.raw
  modified_base (212)..(212): a, c, t, g, unknown or other
  misc_feature (212)..(212): n is a, c, g, or t
  modified_base (621)..(621): a, c, t, g, unknown or other
  misc_feature (621)..(621): n is a, c, g, or t
  modified_base (630)..(630): a, c, t, g, unknown or other
  misc_feature (630)..(630): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccgaggctcacgaaaccaccggtagtaaattggtgttgacgcacggtcctccgaggccacccttgtctttgctccgtaaggggaanacgccctacccgtctccgagtccgacgcctaccgacgccaagtaacgtacgtacccagacgtaccttaaccgtacgacgtcggacccgttaggtacccaggaccgaaaggaccggtcccgtacggggacccgtacggtccctaccccggtacggtttccctaccgtacgttctacgttccgggtcccggttaccgggtaccccagggccgggtacccctacgggtccggtaacctaccgtacccgaagttaccggtaaggttccgaggtcgacggtacgggttgggtacctaggggtactaacgtccgtttaacctccgttaacgttacacgtttacgacgttaagccggtaacgtcggtcgtacgtaacgtaggtactacgttcggtacgtagttactttctacggtnacgtacggnttaacgcgtaggtacctttcacgtttcgtcggtacggtacccggacgtaacgggtacgtaaggtaacgaataacgtaaggttacagggttccataccgagtacttcgtcggttcc

SEQ ID NO: 145980 - DNA, 704 bp, Homo sapiens
  misc_feature: GYAE6OF01E03GL.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccaccctgttctttgtctaccgaaggggaaagcgcccaccctctcctgcacgcctccagccaagtaatactccgagacgcttaactacatacgcctaggtaccagcaagacgcctggaccaggcctccgacggtttcccactatcgtagtcggccgttcgggtacccaggacgggcctacggtcggactaccgtcccgaagtccgtaggttcaggtcggacgtagggttcgggtcgtacggactacgtcctttacgcttctacagttactagttacgcgagtacgtggacgtctaagtaacgtcgtttcgacgtacgttattaacgtttagtcgtacgtaagtacgtaagttacgtacggttaacctttccgtacccgtttggtaccgggtttaccggtaccgggtaaaccggtaaacggggtaaaccggttaaacggggtaaacgttaaaacgggtaacggtaaaaccggtacggttacgggtacggttacccggtagttaacccgtaccgttaagttccggtttaccg

SEQ ID NO: 145981 - DNA, 799 bp, Homo sapiens
  misc_feature: GYAE6OF01CPI9C.21.4.A04.1.454.CMB.1.raw
tcagtcgtcgctcgcacgaccggtgctcgatttagagtagtgatcaggggagagctgctcagttaggacccagagggaaccatcggaaaccccagcgcagtcttctcttcctcctgctactcgtggcctcccaggctcaacgaaaccaccggtaagtaaattgtagttagacgctagtcctccgacggcctacccgttgttctttcgtaccgtaccggaaggggaaacgaccgacccctaccccgtcctccgtacgcgacgtacctaccgacgaccgaagtaactacgtacccgaagtacgtacctaacgtacgtacttaccgccgttacggaaccaggaccgaacggacgtccgtcggaccgtaccggtccgtaccgttacggttcctacgtactcgtacgtcggtccggtccggtaccgacggaccggacctacggtacggcctaacgtcccgaagtccgttaggtacggacggtcgacggtagggttcggtacgacggtaactacgttaccttactaccttcgtacgttaacgtacgtaacgttaccgacgttacggtacggtaacggtacgttaccgtaaacgggttacgtttaccgggtaccgttaagttaccggttacgtttacttacgggttctaaaccggttaggtaacccgttaggtttaaacgtcgggttaaccttccgttaccgttcggttacggtaccggtacggaacgttaaacgggaactaaaggtacggtaacaaacggttcgtacgaggtcgttaccaagtcccgtaacttcgttgttacccg

SEQ ID NO: 145982 - DNA, 897 bp, Homo sapiens
  misc_feature: GYAE6OF01CXD0U.21.4.A04.1.454.CMB.1.raw
tcagtcgtcgctcgcacgaccggtgctcgatttagagtagtgatcagggggagagctgctcagttaggacccaggagggaaccatacggaaaccccagcgcagtctttcctccttcctcctgtaccttctcgtcggcctcccgaggcctacaacggaaacccgaccgggaagtaaagtttggtgttacgaccgcagttcctaccgacggtaccctacccttggttccttttcggtccgtaacccgggaaaggggggaaaacgcccgtaccccctaccccttccgttcccgtcggacctacggcccttacccgaaccgacccggtaaaaggtaaactttaaccgtacccgaaaggtaccgtaaccttaacctaaactaacggtacggttaccccgttaaggtaacccgaagaaccgtaacggaaccggtccgaccggaccgtccggtcccgttccgttaccggtttaccaccgtagttacctcgtccggtccgggttaccggacccgaacggccgggacctaccgggtacgacccgttaccaccgacggtaacggttacggtacgggtacgtgggtaccgtggggtacggtaccggtagggactaccgttccgttacgttaccaacgttacacgttaaccgtatacggacgtaacggtcggtacggtaccgtaacgttacgtaacggttacgttccggtaagttagtttaccgttattacgggttcaacgttcggtaagttacgggtaaccgtttagttaacccgtcgttacccgtttcggtacgggtttacccggaccggtaaagggacggttaaccgggtaaaagaaccgttaaaggtaacgtaacggttccggaaggccttaacggaccggtttaacacgttcgttcggttaacc

SEQ ID NO: 145983 - DNA, 786 bp, Homo sapiens
  misc_feature: GYAE6OF01CU7NS.21.4.A04.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcacgaaaccaccggagaaattgtgttgacgcagtcctccgaggccaccctgtctttgtctccgaggggaaacgcnccaccctctcctgcagcctccagtaccaagatactaccgagtacgtaccttaactacacgttacgcccttacgggtaacccaggaccaaacggtaaccgcccgttacggggacccaacgggtcccttccccgtaacgggtttccctacgtaactttcctagtcggtcccggttcgggtacccccaaggaccgggtccctaacgttcggaccctaaccgtcccgaaggtaccgttacggttaccgaggttcgggacgttaggggtttcggggtccgtaaggggtaacctacggtttacccttccgtacctttccgacgtaacgttaccttaaggttaccgtacggtaacgaccggttaggtaccgtacgttaacggtacgtttaaccgtttcgaacggttacgttacggttaactttacgtacgtacgtacgtacgtaaggttaacgttacggggtaacttcccgactttccggtcggtttaccgtaccggaccggtaaaccgggtaacgtaaacgggtaaacgtaaacgtaaggtaaaccgttgtaggtcgtacgtcgacctaactcgttcgttccg

SEQ ID NO: 145984 - DNA, 844 bp, Homo sapiens
  misc_feature: GYAE6OF01BH253.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagtaaattgtgttgacgcagtctcaggcaccctgtctttgtctcgaaggggaancgcccaccctctcctgcacgcctccacgccaagaatactacccagacgtacttaacctacattacggcccttcgggtaacccagaccaacggaacggtcccttgggacccacgggtcccttccccgtaacgggtttccctaccgtacttacttagtcggtcccgttcggggtaccccacggaccggggtccctaaccgttcgggacctaccgtaccccgaacggtaaccgtagggttttaccgagggttcgggacgtacggggtttccgggtacggttacgggggaacctacgggttaaccctttcgaacccgttcttacgtaacgttacttacgttaacggtaacggtaccgggttacgggtacggtaccgttaacggttaaacggttacgtttaccggtaccgttaaggtttacggttaattttaccggtggttaccgacggttacgtaacgggttttaagtacgggttaacgtttaccctaaccgtttccggttacggtttacccggttacccggggtaacccgggtaaaccgggtaaaccggtaaaacgggttaaaacgaaaacggttaacggtaaaacggtacgttacgggtacggtaccgtacggtacccgttaacctacgtttccgttcgttacccg

SEQ ID NO: 145985 - DNA, 699 bp, Homo sapiens
  misc_feature: GYAE6OF01D6MSG.21.4.A04.1.454.CMB.1.raw
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
  modified_base (302)..(302): a, c, t, g, unknown or other
  misc_feature (302)..(302): n is a, c, g, or t
  modified_base (690)..(690): a, c, t, g, unknown or other
  misc_feature (690)..(690): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgctccgaggggaaangccacctctcctgcagctccagccagaactactccagacgtctactactatacgccttggtacccngacagaacgccgtggaccgagcctcccgaggtttcccncgatcgtagtcggtccgtcgggtcccaagacgggcctacgtgggacctacgtacccgagtaccgtaggttacagggttcggactagggtcgggtactcgggaacacggtacctttacgaccgttactacgtacgtactaacgtttacgcgtaacggtacgtacgggacgtaccgttaaggtaacgttacgtttccgacggttaagttacgtttaacgtttacgtacggttcgaaggttacccgtaaggttaacggttacgggttaaccgtttcccgtacctttcggtcgggtttaccggttaccggaaccggtaaacgggtaaacccgaaggttaaacgaaagtacggtaaacgtacgtacgggttacgacgtacgactaacccggtnttccgttcg

SEQ ID NO: 145986 - DNA, 784 bp, Homo sapiens
  misc_feature: GYAE6OF01B563Z.21.4.A04.1.454.CMB.1.raw
tcagtcgtcgctcgcacgaccggtgctcgatttagagtagtgatcagggggagagctgctcagttaggacccagagggaaccatcggaaacccagcgcagccttctcttcctcctgctactctggcctcccaggctacaacgaaaccgaccggaagtaaattgtgttgacgcacgtcctccacggcctacccttgttctttcgtctaccggaaggggaacgcgccctacctcctcctcgacacgtcctaccgacgaccgaagtaacttactaccgaacggtacgtacctaactaacgtacgtacgtccgtacggtaaccagacgaaggaacgtccgtacggaccgtacggtccgtacccgtacggttcctacgtacttctagtcgtccggtccggtacccgacggtacggcctacggtacgcctaccgtacccgaaggacggttacggtcgacgggtcggtacggtacgggtttcggggtacgtacgggaacgtacgttaccttacgtaccttactacgtacttacgtaacgtacgacgtaacggtacgtcgggtaactacggttaagtaaccgttcgtttaccgaacgttacgtttattacgttacgtagtaccgagtacgtaagttacggtacgttacgttccgtacgttcggttaccggttacgggtaccggtaaccggtaaagggtaaccgtaaagggtaaaccgtaaagggtaaccggttaaacggtacggtcggttaacggtacgtaccgtaccttaaccggttacgtcgtttaccgg

SEQ ID NO: 145987 - DNA, 843 bp, Homo sapiens
  misc_feature: GYAE6OF01D9WD4.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaattgtgttgacgcagtctcaggccaccctgttcttgtctccgagggaagcgccacctctcctgcagcctaccacgaccaagaactactcccgaagtacgtccttaactaaccgagtaccggtccgtacggtacccaaggaccaaggtaaccggtcccgttacgggacccgtaacggggtccccttacccccggtaaccggttttcccctacgtaaccgtttccttaggtcggtacccgggttccgggtacccccgaacggtaccggggtacccctaccggttgggaccctaacccgttcccggaagggacccggttaaggttccgagggtcgggtacgtaggggttcggggttaccggtaacggggaactaacggttacctttacctaccgttacctacgtaagttacctaagtttacggaacgtacgttaacggtgtaacggtacttaagggaaacgtttcgttcggaacttacgggttactttaactttaggtaccgtaacgacgtaacgttagttaacggtacggtttaccgtttaccgtccgtttaacggttccgggtttaccggtaaccccggggtaaccgtaaaacggggtaaccggttaaaagggttaaaactaaacgggttaacggaaacccggttagtacggtaacgtcggttaaccgaacctaaaccgttcgttcttaacgg

SEQ ID NO: 145988 - DNA, 761 bp, Homo sapiens
  misc_feature: GYAE6OF01A4JFT.21.4.A04.1.454.CMB.1.raw
  modified_base (186)..(186): a, c, t, g, unknown or other
  misc_feature (186)..(186): n is a, c, g, or t
  modified_base (550)..(550): a, c, t, g, unknown or other
  misc_feature (550)..(550): n is a, c, g, or t
  modified_base (749)..(749): a, c, t, g, unknown or other
  misc_feature (749)..(749): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgggagtttgggctgagtcgttgggttttccttgtttgtttattttacaaggttntccagtgtggaggtgacagtcgtgggtaggtaggtcggtgggggatacgttcggtccacggccggttgggacgggttccctaggacgtaccttccgccgttgttcggacctacggtccctcgtacgacttacttaccctaccgtttccaagttccgaaccccaacgtaactagtcgggaaccgttcgggtaccccgaccgtacggtccgtacccgggaagggggaccggggtcgtacgggacgggtcggggtccggtaacccgttaagtaaccgaaaagggaactaccgtaaagtacgttaacgagtaaccaggtaaacgtcggacgtcgtacgtaggtaggaaaacgggtacgtacctaactntacaacgtaagacgtataacgtaagtaaccaaagtaaccgttctaacgtcgttatacgtaacgaactaaagtaacaacgtaacgtccgtaaaacgaaaccgaacgggaaccgacggttaccgtagttaacgttaagttcgggtaacggtaaacggaaagaaacggttagtaagggtttacgtagggttacggtggttanggttcggtaacg

SEQ ID NO: 145989 - DNA, 880 bp, Homo sapiens
  misc_feature: GYAE6OF01B3E5W.21.4.A04.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctacagaaccacggagaaattgtgttgacgcagtctcaggcaccctgtcttgctcaggggaancgccaccctctcctgcacgcctccgagtccagaatactccagactctaactacagtacgtccgtaggtaccagtaccgaagaacgtccgtcggaccgacgggtacccttacccccggtaaggtttcccctacgtaacgtttacgttaacgttcggtcccggtttaccggggtaccccaacgggtaccggggtacccctacggttcgggacctaaccccgttcccgaaacgggtaccgttaacgggttctaacggggtcgggtaccggtaggggttcgggtaccgttagggggaactacgggttaccttcgtaccgtttaccgtacctaacgttacgtaaactttaccgggaccgtaacggtacgtaacgggtaactacccggttagtaaacggtttacgtttcgaacgttaacggttttacgtaactttcgtacgttccgaagtaacgttaaggttaccggttaacggttaaccggttaccctttaccggttacggttacggtttaacccgggttaccccggttaaccggggtaaaaccggggtttaaaaccggtaaacgggttaaacgggttaaaaacgtaaaccccggggttaaaaacggggtacccgtttcggggttaaccgggtaaccctttacccgggtaaaccccttaaacccggtttaacgtttcccgggtttaaaccg

SEQ ID NO: 145990 - DNA, 839 bp, Homo sapiens
  misc_feature: GYAE6OF01CE3L0.21.4.A04.1.454.CMB.1.raw
tcagtcgtcgctcgcacgaccggtgctcgatttagagtagtgatcaggggagagctgctcagttaggacccagagggaaccagtacggaaacccagcgcagcttctcttcctctgctactctggtctccgagctcaacgaaaccgacggagtaattgtgttgacgcagtcctaccgaggtcctaccgttgttctttcgtccgtaccggaaggggtaacgacgccctacccgtcctaccgtacgcctacgacctaccgaacgtccgaagtaactaccgtaccgaacgtacgtacctaaccgtacgaacgtacgtaccgtacggtaaccacggtacgaacggaaccgtccgtacgggtaccgacggtacccgttacccgttaccggtttacctacgtaacgttcgttacgttccggtaccgggttcccgggtaacccgtacggacccgggtacctacggtccggtaccgtaccgtaacccgtacggtaccggttacggtttacgacgggttcggtacggtacggttcgggtcggtaacggaccgttacgtaccgttactaccgttactacgtactaccgttacgtaacgtcgtaagtacgtacggtaccgttacgtaaggttacgttactacggtacgttaagttacggtttaacttcggtacgttacgagttaaccggtacgttaacggttcggttaaccgttcgttaccggttacgttaccggtcccggtacggggacctaaacggggtaaacgttaacgggtaaacgtaacggttaaacggaaacgttccgggttagtaccgggtacctacgtaccgtacgttccgtttacgttaccc

SEQ ID NO: 145991 - DNA, 743 bp, Homo sapiens
  misc_feature: GYAE6OF01BQX4T.21.4.A04.1.454.CMB.1.raw
  modified_base (669)..(669): a, c, t, g, unknown or other
  misc_feature (669)..(669): n is a, c, g, or t
  modified_base (734)..(734): a, c, t, g, unknown or other
  misc_feature (734)..(734): n is a, c, g, or t
tcagtcgtcgctcgcacgaccggtgctcgatttagagtagtgatcagggggagagctgctcagttaggacccagagggaaccatacggaaaccccagcgcagcttctcttcctcctgctactcgtggcctcccgaggcctcaacgaaaccgacggagtaaagttgtgttgacgctagtcctccgaggcctacccttgttcgttttgtccgtaccgaaggggaaacgcgcccctacccgtcctccgtgcacgtcctaccgacgtaccaagtaacttaccgaccctaaggactaccttaaccgtaactacgtaaccggtccgtacggtaacccgacgaaccgaacgaaccgtcccgtaccggacccgtaccggtacccgttaccccgtacggttccctcgtaacgttcttagtcgtaccggtccggtacccgacggtacgtccgtacgtacgactaccgtacccgtacgacgtacggttcgacggtcggtacggtacgggtcgggtacgtaccgggaacgtacggtaccttacgtaccgtaccgtactacgttacgtaacgtataccggtacgtacggtagacctacggtaagtaacgttaacgttgtaacgttgttacttacgttacttacgataccgtagttaagtacgtacgttacgtctacccgttntccggtacgtacggaacgtaggacgaaggtacgaagtaacgtacgacgtgacgtcgacacacttntcgttaccg

SEQ ID NO: 145992 - DNA, 717 bp, Homo sapiens
  misc_feature: GYAE6OF01BLX84.21.4.A04.1.454.CMB.1.raw
  modified_base (205)..(205): a, c, t, g, unknown or other
  misc_feature (205)..(205): n is a, c, g, or t
  modified_base (506)..(506): a, c, t, g, unknown or other
  misc_feature (506)..(506): n is a, c, g, or t
  modified_base (580)..(580): a, c, t, g, unknown or other
  misc_feature (580)..(580): n is a, c, g, or t
  modified_base (682)..(682): a, c, t, g, unknown or other
  misc_feature (682)..(682): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctacacgaaacccgaccggagaaattgtgttgacgcagtcctccaggcaccctgtctttgtctcgaaggggaancgcccaccctctcctgcacgcctccacgccaagaagtactccgagacgtacctaactaccatacgccgtacggaccagacgagaacgccgtggcccgaggcctcccgtacggttccctagtacctcgtagtccgacgttcccggtaccccacggaccgggtcctacggtcggtacctaaccgtcccgaacgacggtacggttaccgaagggttcggtaccggtagggttcggggtaccgtaggggaacccttaacggtaccctttccgaactttccctaacgtactacgtaacttaccggngtaccgtaggtaccggaccttacgtaaggtaacgttaccgttgacgttagttacgttagttaccgtgttaccgngtaacgtaggtacgtacgggtacttccggtacttcggttacgtacggtaccggtaccggaacgggttaacaaggtaaacgtaagtaaccggaaggttacggngtaccgggtctacggtaacctcgtctttccgtacg

SEQ ID NO: 145993 - DNA, 914 bp, Homo sapiens
  misc_feature: GYAE6OF01ELJU5.21.4.A04.1.454.CMB.1.raw
tcagtcgtcgctcgcacgaccggtgctcgattttagagtagtgatcagggggagctctgagtagcggtagccccagccccgagaacttcccgaacggtgttttaccatttggtgtatctacgtaccactcgaaacacaggacggtacctacaacctatcgggtaggtttagggctgagtcgttggttttccttgttgttattttacgaggttgtaccgtagtgtgaggtgcacgtctggtcgtaggtcggtaggggacgtacgttcggacctacggtccggtagggaaccggtcccctagaacgtaccttccgttccgttcggtccgacgtaccgtaccgttcgtacgtaccttaccgttaccctaccgttacgacgtaccgaacccaactaaccgtacggtacggtaccggttccgggtaccgaccggtaccggtaccgtaaccgggaacggggtacgggtacggtcgggtacgggttccggggtaccggttaccgttaaacgtaaacggaaaacggtaacgttaaccgttaaacggttacggttaacgtaacggttaaacggtaacggtaacggtacccgggtcggttacggttacgttaacgggtaaacgggtaaacgggttaccgttaacccgtaaccgttacgttaccgtaaacggtaaagtacgtaaccgttaacggttaaccgtaaaccgtaaacgttactaccgtttaagttacgtttaaacgttcgtaacgaaagtaaacggttaaccgtaaacggtaccgtaaaccgggttaaacggaacccgggtacggttaacccggttaccggttacgtttagttaaacgttaaggttagggtaaaccgtaaagtaaacggttaaacggcggttaagtacgttgggtagggttactcggtagttacggacg

SEQ ID NO: 145994 - DNA, 870 bp, Homo sapiens
  misc_feature: GYAE6OF01AZBAR.21.4.A04.1.454.CMB.1.raw
  modified_base (861)..(861): a, c, t, g, unknown or other
  misc_feature (861)..(861): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctcggctcccaggctcaacgaaacccgaccggagtaaattgtgttacgacgctagtcctccgaggccaccgttgttctttgctaccgaaggggaaatcgacccacccgttctcctgggacacggtccttaccgaacggtcccaaaggtaactttaccgacccggaaggtaacgtccttaaacgtaactaacggttaaccggtacccgtttacggaaccaacgtacgaacggtaaaccggtcccggttagggacccgtacggtacccttaccccggttaaccggtttcccacttaacttcgttaagttcccggttaccgttacccggggtaccctaaccgggaaccgggtcccttaacgggccggtaccttaccgacccgtaacgtaacggtttaccggtttacgaacgggtacgggtccggttaaaggggttcccgggttacggaacggggttaacccgttaacggtaacccctttccggaaactttcccggtaacttaaccgttaaggttaattaaccggagtaccgtacggttacggacctacgtaaggttacgttaacgttccgtacgttagttacgtattacgtagacgtagaccgttaaggttacgtagttacctaccgtactttacggttacggttacggttaccggaaccggtaacgggttaaccggaaacgggtaaagtaaccgttaaacgggtaaaccttagggttacgtacggtcctacgtaacctaccgttnttcggttac

SEQ ID NO: 145995 - DNA, 722 bp, Homo sapiens
  misc_feature: GYAE6OF01BET4Z.21.4.A04.1.454.CMB.1.raw
tcagtcgtcgctcgcacgaccggtgctcgatttagagtagtgatcaggggagctctgagagcggagccccagccccagaattccccaggtgttttcatttggtgatcagcactgaacacagaggactcaccatggagtttgggctgagctgggttttccttgttgttattttacaaggtgtcctagtgtgaggtgcagcgtggtggagtcgtgggggatacgttggtccaggccgttgggacgggtccctgtacgaccttctcccgtgtcggcacggcccttcgtgctagttaccacctttcgagtacgaacccaacaacatcggtaccgtcgggtccccgcgaggcctccggaagggggaacggggcgtcgggagggttcggggtaccggtccgttaacgttacgaaaggaacgtactaaacgtagttaacagtacagtaatcggctcgtactggtaacggaaaggtacggttaccaactacttactacgaaagacgtagtagtaattaacaaaacggttactacacttgtacttacagtaacaagtaacggaaacgtacgtaccgttaaacggaaaaacccggcggtaaaccgccgggtaaccgtaggtttaacgttagtttacgggttaacggtaaaggtaaacgtaaaaaggggtacggttaggggaaacggttttggggttaacgggttagggtaacggttccggtgggttaaaccg

SEQ ID NO: 145996 - DNA, 789 bp, Homo sapiens
  misc_feature: GYAE6OF01BRP30.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcctaccctgttctttgtctccgaaggggaancgcccaccctctccctgcacgctaccacgaccagaatactccaagacgccttaactacagtacgtccgttacggaccagccaaggaacgtcccgtggacccgaggtcccgttaccccgtacggtttcccctcgtaactttcctacgttcggtacccggttccgggtacccccaacggtaccgggacccctacggtggaccctaccgtacccgaaggtaccgtaacgggttaccgaaggggttcggaccggttaggggttcggggtaccgttaacggggactaaacgttccgtttacccgactttacccgtactacttacgtaacttacgaccgacggtacgtagggtacgtaccgttaagtaacgtttcgtttacggacgttagtttacgtttaactttcggtattacgaagttacgttaaggtttaacggttacgggttaaaccgtttcccgtacctttcggtaccgggttcccgggttaccggaaccggtaaacgggtaaccggtaaaggtaaacgtaaacggtaacggtaaaccgttacggtcggttacggtcctacggaccttaccgtcgttccgttaccg

SEQ ID NO: 145997 - DNA, 862 bp, Homo sapiens
  misc_feature: GYAE6OF01A3Z8U.21.4.A04.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagtcgtcgctcgcacgaccggtgctcgatttagagtagtgatcaggggagctctgagagcggagccccagccccagaattcccaaggtgttttcatttggtgatcagcactgaacacagaggacctcaccatggagtttgggactgagtctgggttttcctgttgttatttacgaggtntctagtgtgaggtncagctggtggagtcggtggggggactacgtttcggtccgaggtccgtagggacgggtcccctaggacgtaccttcctccgtggtacgctacgtccctcgtggtacctattcccgtacctttcgaagttcgaacccctaacgaaaccgtagttaccgggaaccgttcggggtacccgaccggaacggtccgtacccgggaaggggggaaccgggtcggtacggggtagggttcgggggtacccgggtaccggttaagttaacggaaaagggtaaaccgtaacgtaaacggtaacggttttaaacaacggttaacccgaaaggtaaccggtaacggggtccgtaaccggttacttaaggggttaacggtaaaacgggggtaacggtttccccaaaccggttattaaccccggttaagtaaaggtaaacgggtaactttacggtaaaacggtttaaccaaaaacgggttacctaacgttaacgttaggtaacctacgtaacgaacgtaaagtttcggaaaaccctggtacccgtaaaacggaaaccggtacgaaccggtacccggttagttaagttttactaacgggtttgggtaaaacgttaggaaaacgggttaagtacggttaagggccttagggggttcggaaaggttccgttacgtacgggtaac

SEQ ID NO: 145998 - DNA, 755 bp, Homo sapiens
  misc_feature: GYAE6OF01B527B.21.4.A04.1.454.CMB.1.raw
  modified_base (213)..(213): a, c, t, g, unknown or other
  misc_feature (213)..(213): n is a, c, g, or t
  modified_base (602)..(602): a, c, t, g, unknown or other
  misc_feature (602)..(602): n is a, c, g, or t
  modified_base (647)..(647): a, c, t, g, unknown or other
  misc_feature (647)..(647): n is a, c, g, or t
  modified_base (668)..(668): a, c, t, g, unknown or other
  misc_feature (668)..(668): n is a, c, g, or t
tcagtcgtcgctcgcacgaccggtgctcgatttagagtagtgatcgaggggagctctgagagcggagccccagccccagtaacttcccaggttgttttcagtttggtgatcagcactgaacacgagagactcacctagtggtagtttggactgagtcgtttgggttttccttgtttagtttattttacgaaggttcgtcctagtggtgaggtncgaggtcgttggggtcggtaggttccgggtaggggggtattaccggtttcgggacccgtacggtccggtaggggtaccgggttccccttaggaccgttaccgttccgtcgtggtacgccgtaccgtccttacgtgacccttaacgttccctaccttcgtacggtaccgaaccctaaacgacgtagttccgggtaccggtccgggtcccgacgtacggcccggtacgggaaggggtacggtcgtagggcggttacggggtccgtaacgttagttaaccggaaaggtaacgttaacgtaaagtaacgttaacgtaaggaacgtaaggtaacggtcgaccgttgtacggttaggtaacgggaacgttacggttaccaacgtataccggtaanaacggtagtacgtagtaactaacgaacgtactactacgtgtacgntaacgactaaggtacaaccgngtaccgtaaacgacacgtaccgcggtattgtacgtgtacgaaggtacaaagttcgagtacggtggttgtggagttcgtacgggttac

SEQ ID NO: 145999 - DNA, 706 bp, Homo sapiens
  misc_feature: GYAE6OF01E2B6V.21.4.A04.1.454.CMB.1.raw
  modified_base (145)..(145): a, c, t, g, unknown or other
  misc_feature (145)..(145): n is a, c, g, or t
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (278)..(278): a, c, t, g, unknown or other
  misc_feature (278)..(278): n is a, c, g, or t
tcagtcgtcgctcgcacgaccggtgctcgatttagagtagtgatcagggggagagctgctcagttaggacccagagggaaccatcggaaaccccagcgcagcttctcttcctcctgctactctggcctcccagctcacgaaaccncggagtaattgtgtgacgcagtctcaggccaccctgtctttgactaccgaaggggaancgcccaccctcacctgcagtcctccagccaagactacnccagacgtcctaactacagtaacgcccttaggaaccngaccgaagaaccgtccgtggacccgaggccctacccgacgtttcccatacttcaagtccggccgttaccggggaccccagaccggcctaacgtcgaccctacgcccaggacgtaggttccagggtcgcgtaggtcgggtcaggaacctaggtaccttccgactttccaactagttaccaagttacgaccgtaaggtacgtacgggaactaccggtagtaacgtactttaccggaacgttacgttacgttaaccttacggttacgtaaccgtaagtaccgttaaggttaaccgtacgggttaaaccttaccgaccgtttcgttacgttacccggtacggtaaccggaaacgggtaacctaaagggtaactaaacggtaacgtaaacgaacgtggttaacccgtcgaacaccctacgttagtccgttacg

SEQ ID NO: 146000 - DNA, 965 bp, Homo sapiens
  misc_feature: GYAE6OF01CWGI3.21.4.A04.1.454.CMB.1.raw
  modified_base (155)..(155): a, c, t, g, unknown or other
  misc_feature (155)..(155): n is a, c, g, or t
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcaagaaaccaccggagaaattgngttgacgcagtcctccaggccacccttgtctttgctaccgaggggaaancgccacccgtctacctgcagcctaccagaccaagtaactctaccgagacgaccttaacactacgtacgcccgttacgggaaccaggaccaaggaaccgtcccgtacggggaccctaacgggtcccttaccccggtacggttccccagtttaccgttaagtccgtccggttcccgggtaaccccgtacggaacgggtaccccaccggttaccgggaccctaacccgttaccccgaacggtaaccgttaaccgggtttcggtaaacgggttcggggtacccggtaggggttacggggtttccggtaacgggggtaacctaaccggttaccgttaccttaaccttcccgttaaccgtaacgtttaccgttaacgtttaaaccggaccggtaaaccggggtttaccggaaacggggttaacccgtaccgggtttaaacgggttaaacggttttacccggtttaccgtaccgggtttaacgggttttaacgtttaaccgttttaccggtttaacggtaccggtttaaaccggtacggtttaaacggggtttaaccgtttaacgggttaaacccgtttacccgtttaaccccgttcggttttaccgggttaacccggttaaccgggtaaacccgggtaaaaaccgggtaacggttaaaacggggttaaacgtaaaacgggttaacgtaaaaaccgggttaccggttaggttacgtaacccgttacggaacccttaacggttaacccgttcgtttaccggtttaaccc

SEQ ID NO: 146001 - DNA, 654 bp, Homo sapiens
  misc_feature: GYAE6OF01DALNP.21.4.A04.1.454.CMB.1.raw
  modified_base (514)..(514): a, c, t, g, unknown or other
  misc_feature (514)..(514): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctggagtcttgggttttcctgttgttatttacagtgtcagtgtgagtgcagctggtggagtcgtggggatacgttggccagtcccgtgggacgggttccctaggacgtacttccgtcctggtacgctacgtccctcgtagctacttcctaaccttgacgtcgaaccactaactagtcggaactcgggtcctacgacggtccgtaccggaggggtaacggggtctaggggtacggtcgggttacccggacgttaacgttaacgaaaggtaaacgtctaaaacgtagttaacagtaacagtaaacgcggcgtgtcgtaggaacgaagtaacgtacacctatacacaagagtaactagacttaacgaaagttaccncgtatagtactctagtaacaaagtcaaacgcgtacgaacgaacgacgacgtaacggtccttagtaacttaggttgtaaggtaagtaaacggaaaggtaggtacggtaggttacggtaggttacggtaagtgtcggtaacg

SEQ ID NO: 146002 - DNA, 838 bp, Homo sapiens
  misc_feature: GYAE6OF01EVZV4.21.4.A04.1.454.CMB.1.raw
tcagtcgtcgctcgcacgaccggtgctcgatttagagtagtgatcaggggagctctgagagcggagccccagccccagaattcccaggtgttttcagtttggtgatcagcactgaacacagaggactcacatggtaggtttggctgacgtcgttggttttccttgttgtttattttacgaaggtgtccagtgtgtaggtgacagtcgtgggtggtacggttgggtagggggtacgtacgttcgggtcccgaggtccgtcggggtacgggttcccctaggacgtaccgttccgttccgttcggtcgtaccgacgtccctcgttcgactaccgtttccctaccttacgacggtaccgaaacccaactaaactaggttacgggtaacgttcggggttacccgaccggtacggtaccgtaccgggagggggtaacgggtcgtaggggtacgggttcgggtccggtaacggttaacgtaaacggaaaaggaacgtaaaccgtaaacgtaaacgttaaccaaggtaaacacggtaacgtacgggccgtacgtcgtaggtaacggtaaagggtacgtaccgtactacgtacgtacgtaagtaagtacgtagtaacgttacaaacgtactacgtacgtagtacgttacgtacgtaactaagaaccgtaacgaacccgtaaccggtaaaccggtaaaccggaacccggtaaccgggtaaccgtaccgggttaagtttaacgttaacgtttaacgggttaaggttaaggtaaaaccggtaaaggtagggttaagggttaaccgggttagggttacgggtttaaggtcggttacggttcggttaaacgg

SEQ ID NO: 146003 - DNA, 777 bp, Homo sapiens
  misc_feature: GYAE6OF01BNXUL.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggaccagagggaaccatggaacccagcgcagcttctcttcctcctgctactctggctccaggctacacgaaaccgacggagtaaattgtgttgacgctagtctcgaggcacctgtctttgctacgagggaacncgcctacctctctgcacgtctaccagtccaagtactactaccgagacgtctactacactaaccgtcggtacagacagacgccgtacggccacggtaccttccgtacggtttccctactaacgtttaccgttacgtcgggtaccggttacccggggtacccaaccggtcggggacccgtacgttcggacctacccgttacccggtaacggtaacgttacggttacgacggttacgggtcgttaggggtcgggttaccggtacgggaacgtacgttaccttactacggttccctacgtacttacgtagttacgactaagtacggtagggacccgtacgtacggtaacgtacggtttcgaggtttacgttaacgttacgtttaacgtgtaccgggtatacggtaagttaacgttacggttaaccttaccgtcgtttacggttacggttaccggtacgggtaacgtaaacggggtaaacgaacgggttaaacgggaacgttaaacgggaacgttaacgggttcgggtacgggttaacctccgggttaacccgacgttaaccgttttcgtccgttttacccgg

SEQ ID NO: 146004 - DNA, 879 bp, Homo sapiens
  misc_feature: GYAE6OF01CMQMO.21.4.A04.1.454.CMB.1.raw
  modified_base (144)..(144): a, c, t, g, unknown or other
  misc_feature (144)..(144): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggcctcccgaggctcacgaaaccnccggagaaattgtgttgacgcagtctccgaggccacctgttcttgctccgaggggaaancgccaccctcgtcctgactacgctccgagccaaggaattacnccganacgctactacactagccgtacggtaacctaacggacaacggaaacggtcccgtacgggacccgacggtacccgttccccgtacggtttacccgttccaaccgtttaccgttaagttccggtcccggttaccggggttacccccgtaaccgggtacgggggtaccccccttaacgggtaccggggttacccgaacgttaccccccggaaaggttaacccggtttacgggttaaccggttaaacgggtcgggggaaccggtttacgggggttaggggtttcccggtaaggggggtaaccctaaacggttacccgttttacccgtaacccgttccggttactacccgtacgtaacgttaacgaccgtaacgtacgggttacgggtaacgtaccggttacggaaacgtttcgtttacccggtaagttacggtttagtaacgttttcgtacgttacggttaacggtcccgtaaaggtttacggtaaccggggttaacctccgttaaacccggtttccgttacggttacccgggtacggacccgggtaaaacggtcggttaaaacggtaacgtaaaacgttacggtaaccgtacggttacggacgttcgaacgtcggaacctgtccgtttaaccg

SEQ ID NO: 146005 - DNA, 779 bp, Homo sapiens
  misc_feature: GYAE6OF01ESAXT.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcctaccctgtctttgtctacgaaggggaaancgcccaccctctcctgcacgcctaccgagaccagaactactccagacgtctactacatacgccgtaggtaaccagacaacgacgtaccgtcggaccgtacggtccgtccccgttacggttaccctactacttccgttaagtccggtccgtaccggggttacccaccggacgggtacccacgttcggcctaccgacccgaacgacgtacggtacgtacggtacgggtcgttaggggtcggtacgggtcgggaaccgtaccggtacctttaccgacttaccgttactaacgttaccgtaacgttacgaacgtaacgtaccggtaggtaccgtacggtagtaaccgttacgtttacgacgttagttacgttactttacggtacgtactacggtacgttaacgttaaggttccggttaacgtttacccgtaacctttccggtttacgggtcccggttaaccgggtaaccggtaaaccgggtaaaccgtaagggttaaacaaagggttaacccggtaaacggttacggtagggttaacccggttacgtacccggaaccttaccgtacgttcgtttacccg

SEQ ID NO: 146006 - DNA, 761 bp, Homo sapiens
  misc_feature: GYAE6OF01BLHCO.21.4.A04.1.454.CMB.1.raw
  modified_base (337)..(337): a, c, t, g, unknown or other
  misc_feature (337)..(337): n is a, c, g, or t
  modified_base (694)..(694): a, c, t, g, unknown or other
  misc_feature (694)..(694): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtcagtgtgaggtgcagtctggtggagtcggtgggggagtacgttgggtccaggtcccgtggggacgggtcccctgacgtaccttccgtccttgtggcagcccttcgtgactattcctaccttcagtcgaaccacaaacagtcggaccgtcgggtcccnccgaggtcctaccggagggggaacggggcgtagggagggttcggggtaccggtaccgttaagttaaacgaaaggtaaacgtacctaaacgtaagttaacgagtaaaccgaagtaaaataccgggccgtacggttcgtaggtaacgggtaaaacgggtaacgttaccaaacctagtaccgtaaacgaaaggaacgtaagtacgtaactaacgaaaagtacctaacctaacttacgtacttaccgtagaactaaagttaacgaaactaaccggaccgttaaacggaaaaacccggaggtaaccccggtaacgggtaaccggttaggtttaaacgtttaagttacggggtaacggtaaanaaacggtaaaaggagggttagggtaacgttgggttaccgggtaaggttacggtaacgttggtaaccg

SEQ ID NO: 146007 - DNA, 719 bp, Homo sapiens
  misc_feature: GYAE6OF01ELJ1X.21.4.A04.1.454.CMB.1.raw
  modified_base (508)..(508): a, c, t, g, unknown or other
  misc_feature (508)..(508): n is a, c, g, or t
tcagtcgtcgctcgcacgaccggtgctcgatttagagtagtgatcaggggagagctgctcagttaggaccagagggaaccatcggaaaccccagcgcagtcttctcttcctcctgctactctcggcctcccaggctacacgaaaccgacggagaaattgtgttgacgctagtctccgacggcctaccttcgttctttgtacctaccggaaggggtaaacgcgccctacccttcctccgtcgaccacgtcctacccgacgacctaagtaactaccgtaccgaagacgtacttaaccttacacgttaccgtaccgttacggtaaccaaggaccgaagggaaccgtccgtacgggaccgtacgggtccctcccggttacggttaccactacgttacttacgtcggtcgtaccgggtccaacggtcggacctacgtcggaccacgtacccaggacgtacggtacgacggtcggacgtacgggttcgggtcgtaggacacgtacctctctacngtactacgtatacgacgagtacgagtacgtacgtagtaacgtcttacggcttacggtattactcgtagtacgtagtacgtagtacgtagttaccgttcgtacttcggtacggttaccgtacggaaccggtaaggaaccggtaaggtaacgtaaacggtacggaacgtacgggttaacgcggtaacgtaccgtaacgtacgtgtccgttacg

SEQ ID NO: 146008 - DNA, 843 bp, Homo sapiens
  misc_feature: GYAE6OF01BALQW.21.4.A04.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagagtagtgatcaggggagctctgagagcggagccccagccccagaattcccaggtgttttcatttgtgatcagcactgaacacagagactcaccagtggtagtttggctgagtccgtttgggtttttccttgtttagtttattttacgaaggtgtcagtgtgaggtgcagtcgtggtgagttcggaggggatacgttggtaccgacgccggttgggtaccggtccctagacgtaccttccgtccgtgtcgaccgacgtcccttcgtntacctacctttacgtaaccctttaccgagttaccgaaaccctaacgaaccgtaaggttaccggggtaccgtacccgggggttacccgaccccggtaaacggtccccggtaacggggtaacgggggtaacgggttcccgggtaggggtacgggttcggggtaccggttaacggttaaacgttaaccgaaaggtaaaccgtactaacgtaacgttacgaacgttaacaagtaacgtacggccgtacggtgtaacggtaggtaaacggtacgttaccaactaacggtaccaagtaagacgtaatacgtaactaacgtaaacgtacctaccgtaattcggaacttcgaacgtaacaaacggttaacaacccggtaacgtaacccggtaaacggtaaacccgggaacggtacccggtacgttaccggttacggtttaaagtttaccggttaaggtaaaccggttaaaggaaaaccggtaaaggtttaaggaccgggttaaaggttacggttcgggggtaagttaacccgtcgggtaacgtaacccgg

SEQ ID NO: 146009 - DNA, 934 bp, Homo sapiens
  misc_feature: GYAE6OF01BUSY6.21.4.A04.1.454.CMB.1.raw
  modified_base (744)..(744): a, c, t, g, unknown or other
  misc_feature (744)..(744): n is a, c, g, or t
tcagtcgtcgctcgcacgaccggtgctcgatttagagtagtgatcaggggagctctgagagcggagccccagccccagaattcccaggtgttttcattttggtgatcagcactgaacacagaggactcaccagtggtagtttgggctgagtcgttggtttttccttggtttagtttattttacgaaggttcgtaccgagttgtggaggtgcgagtcgttgggtggagttcggtagggggtatacgttggtccacggtccgtgggaccggtcccgtggaacgtaccttccgtccgtggtcgaccgtaccgtccttcgtacgtaccttacttacccgtacctttaccgaacgttaccgaacccaaaccgtaaccgacggttccgggtaccgggttcccgggtacccggacccgtacgggtacccggttaccgggaacggggggtaacgggtccggttaggggtacggggtacggggttacccggttaacgttaacgtaaacggaaaaggtaaacgtaccgttaaaacgtaacggttaaccgtaaacgtaacggtaaacggtaaacgggtacccggtcccggttaacggttcggtttaaacgggtaaacgggtaaaacgggtttaaccggtttaccccaaacccgttacgtttaaccgtaaccggtaaagtaacgttaagttaacgtaaaccgtttaaacgaaaaccgttacccgtactttaccgttaagttacccgttaacgttanaaaccgtaagtaaaccgaccgtaacgggtaacctaaaaccgggaaaccggacgggtacccgaacccgggtttaccggtagttttaaccgttaaggtttacggggaaagttaaccgggaaaaggttaaagggtacggttaggttaaacggttcggggtttagggtacgtttacggtcggttacgtaacggg

SEQ ID NO: 146010 - DNA, 727 bp, Homo sapiens
  misc_feature: GYAE6OF01CKOS4.21.4.A04.1.454.CMB.1.raw
tcagtcgtcgctcgcacgaccggtgctcgatttagagtagtgatcaggggagctctgagagcggagccccagcccccagaattcccaggtgttttcatttggtgatcagcactgaacacagagactcaccatggagtttggctgagtcgttgggttttccttgtttagttattttacgaaggttgtcctagtgtggaggtgcgagcgtggtggagtcggtaggggagtacgttcggccagtccgtgggacggtccaggacgaccttccgtccgtagtcgcgacgtccctcgtcgactcttacctaccgttcgagtaccgaaccctaacaacgtacggtcggtaccggtccgggtaccccgaccgacgggaccgtaccgggaagggggacggggtcgtggggacgggttacggggtccggtaccgttaacggtaacggaaagaacgtaacgtaaacgtaagtaacaacgtaacgaaggaacgtcggacgtcgttacggtaggtaaacggaaggttacggtacctaccgtaagtacccgtaagaaggaagtaacgtataacgttaacgaaaacctacgtacttaagtctaagttacaacgtaacaaagttacgaactaccgtacgtaaacgaaacgacggtaccgacggtcgtaagttcgttaagttggaaggtaacgaaaacgtaggagttagggtcggttggtacggtaggtcgtaggtgtaaccgg

SEQ ID NO: 146011 - DNA, 806 bp, Homo sapiens
  misc_feature: GYAE6OF01EKX9N.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaaccccagcgcagcttctcttcctcctgcctactctggctcccaggctcagaaaccacggagaaattgtgtgacgcagtctcaggcaccctgtctttgctcgagggaacngcccacctctcctcgacagctccagcaagactactaccgagacgcttaactacacgtacgcccttacggtaaccagtacgaagaacgtcccgtacggcccgtaagggccccttaccccggtacgggttttacccaacttaaccgttcgttaacggttcggtacccggtttacccggggtaaccccaaaccgggtaccggggtaccctaccggttaacgggacccctaaccgggttaccccaaagggttaaccgttaccggggttcggaaccgtttcgggggaaacccgttgggggttccgggtacggtttacgggaaacccttaacggtaccgtttacctacgttcctaacgtaattccgtaatacggaacctaagggaccgttacgggaacgtacccgtaggtaaccgttacgtttaccggacgttaggttacgttaacgttttacggactccgggaagttcgtaacggtttagtacggttaaacgttcccgtacgttcgttacggtccggttacccgtaaacggaacgggaacttaagggaacggtaaagttacggaaacgtagtaacggtcgtaccggttaacacccggtatttaccgcgttaacgg

SEQ ID NO: 146012 - DNA, 1048 bp, Homo sapiens
  misc_feature: GYAE6OF01BJ6VZ.21.4.A04.1.454.CMB.1.raw
tcagtcgtcgctcgcacgaccggtgctcgatttagagtagtgatcaggggagctctgagagcggagccccacgccccagaattcccaggtgttttcatttggtgatcagcactgaacacagagactcaccatggtagtttgggctgagtcgttcgggttttccttgtttagttttattttacgaaggtcgtccgaggttgtaggtaggtgcgaggtcgtgggtagggacggtcgggtagggggtagtacgttcggtaccgacggtccggtagggtaccggtccgacggacgtacttccttccgtcggtcgaccgtacgtcccttaccgtcgtacctttaccttaccccgttaccgtttaccggtaacgtacccggaaaccctaaccgtaaaaccgttaacggttaaccgggtaacccggggttcccggggttacccggaccccgggtacgggtacccgggttaacccggggaaggggggtaaccggggtacgggttacgggggtacgggggtttccgggggttaacccgggtaaccggtttaaccggttaaacgggaaaacggtaacgttaaaccgtaaacgttaaccggtttaaacgaaacggttaaacgtaaacggtaaacggggtaccgggtaccggttcggttaaggttacgggtaaagggtaaaccggggttaacgtttacccaaaccgtttacgtaacgtaaccggtaaaggtacggtaaagttaacgttaacgttaaaccaaaccggttaaacgtcgttaacgttaccgttaagttacccgtaagtaaactttaaaccggaaccggtaaaccgtaacccgggttaaaaccgaaacccggggtaaaaccccggtacggggaaacccggtttaacccgggtttaacggttacgggtttttaaaacgtttacggggttaacgggtaaacgggttaaaaccggttaaaagggtaaaacgggttacggggttacgggttaaaggggttttcccgggggttaagggtttaacccggggttacgtttacgggtacccgggtaaacggg

SEQ ID NO: 146013 - DNA, 843 bp, Homo sapiens
  misc_feature: GYAE6OF01BE6VI.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgttattttacaaggtcgtccagtgtgaggtgcagcgtggtggagtcggtgggggagtacgttcggtccgaggtccgtaggggtacgggttcccctggacgaccttccgttccgttggtcgccacggtcccttcctgtacctatttccctaaccctttacgacggttaccgaacccaacctaacgtagtacgggtaccgttccggggtacccgaccgtaccgggtccgtaccgggaaggggggaacggggtcgtacggggtagggttccgggggtacggtacccggtttaagtaaccggaaaacgggtaaaacgtacctaaaacggtaacggttaaaccgaacggttaacgaaacggtaacgttaacccggggccggtacgttacggtagggtaaacgggtaaacgggttaacggttaccaaacccgttacgttaccgtaaccgtaaaggtaagaaggtttaacgtaaaccgtttaacaaaacggttaacctaccgtaacgttacgtacttacttaccggaaagtaaacgtaaccgaacgaaccgttaaccgtaaaccggaaaaccgggtacgtaaccggtacgggttaccgttaacggttaagttacggttaggtacggtaaagaaacggtaaaggttcggtaggtgtagggttacggtaggtaccgtgttcgtacg

SEQ ID NO: 146014 - DNA, 909 bp, Homo sapiens
  misc_feature: GYAE6OF01E3SVI.21.4.A04.1.454.CMB.1.raw
tcagtcgtcgctcgcacgaccggtgctcgatttagagtagtgatcagggggagctctgagagcggagccccagccccagaattcccaggttgtttttcagttttggtgatcagcactgaacacagaggactcaccagtgggtagtttgggctggagtcgtttggtttttccttggtttagttttaagttttacgaggttcgtacctaggtggtggagggtgcgagtcggttgggtgggtaggttcggtaggggggactaccgtttgggtaccgacggtccggtaggggtaccgggtcccgtaggtacgtcctccttccgtgtcggccgtacgtcccttcgtcgtaccttacgttacccttacccttacggtaacgtaccgaaacccctaacgaaagtacggttccggggtaacccggttccggggtaccccgtaccggaggggtccccgtaacggggaaggggggtaacgggccggtttagggggacgggtttccggggttacccgggaaccggtttaaaacgtaacggaaaagggaaaccgtacgtttaaactacgggttaagaacggttaaacgaacggttaggacccgggtcttaccggttaggtaagggtaacgggaaacgggtttaccgttaccggaaccttagtaccgtaaaggaacggtaagtaagttaacgtaacgttaaaccgtaaacggtaacccttcgtttaactacggtttaaccgtagtactaaagaacgtacgaaaccgtaccgaacggttaaaccggaaccggtaacggaaccgtacccgggttacgttaacgttaggtttaacggtttacgggaacggtaaggaaaacggttaaacgggtggttaacggtagggttagggttacgggttaggttacgcggggttataaccggg

SEQ ID NO: 146015 - DNA, 763 bp, Homo sapiens
  misc_feature: GYAE6OF01EEIOS.21.4.A04.1.454.CMB.1.raw
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
  modified_base (598)..(598): a, c, t, g, unknown or other
  misc_feature (598)..(598): n is a, c, g, or t
tcagtcgtcgctcgcacgaccggtgctcgatttagagtagtgatcaggggagctctgagagcggacgccccagccccgagaattcccaggttgttttcagtttggtgatcacgcaactgaacacagaggactcacagtggtaggtttggctgagtcgtttggttttccttgttgttatttacgagtctcgagtgtgagtgcngtcgtggtgtaggtcggtaggggatacgttcggaccgagtccggtggaccggtcctggaacgtcttccgtcgtagtcgctaccgtcctcgtgccttacgttcctacttgacgtcaaccgtaacagtagtcggtccgtccgggtccaccgcggaccgtacggggagggtaacggtgtagggcggtacgggtcttaccggtaaataacgaaaaccggtagacctttaaaggtacgttaaacgngaaaccgtaaaggaccgggtaccgacggtggttaacgtagggtaaacggtaaaccggttcgtaaccctacgtaacgtccgttaaacgaaggtacgtaacgttacggtaaacctaacgtaaacgtacctacgttacgtagttaaccttacggtaanaaccgtaacggtactaaaccgacgtaaaccgtaaacgaacccggtacgtacccggtagttaaccgtagggttacttaacgggttaagtaacggtaaggttaaaccgtaggttaaacgggtgtaaacgggtttcgggaacgttagggtacgttcggtaataaccgg

SEQ ID NO: 146016 - DNA, 796 bp, Homo sapiens
  misc_feature: GYAE6OF01BUCIL.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctaccgaggggaaacgacgcccacccgtctccgtgcctagcctccacggaccaagtaaactactccaaggacgacttaacgtacaatacgccgttaggtaaccgaaggcgaagaacgtccgtcgggacccgaacggcccgtaccccgtacggtttccctacgacctttacgtaacgttcgtacccggttccgggtacccctaacggaccggggtaccctaacggtccgggtacccacgttaacccccgaaggtaaccggtacggttacgaaggggttccggacgtacgggttccggggtcgtaacggggacctaacggtaccttccgaaccttccgtacggtaacttcgtaacgttacgacgtaaggtaccgtacgggtacgtacgtacggtaacgttacgtttcgtaacgttaggttacgtttaacgtttcgttataccggtagtaacgacgtttacggtacggttaacgttaccttacccgttaggttaccggtttaccgggttaccggacccggtaaacgggtaaaccggtaaagggtaaaggtaaacggtaacgtaaaccggtaagtacggtacggcttacggaaccctacgtacgttcgtacg

SEQ ID NO: 146017 - DNA, 914 bp, Homo sapiens
  misc_feature: GYAE6OF01EHB7F.21.4.A04.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (769)..(769): a, c, t, g, unknown or other
  misc_feature (769)..(769): n is a, c, g, or t
tcagtcgtcgctcgcacgaccggtgctcgatttagagtagtgatcaggggagctctgagagcggagcccccagccccagaattcccaggttgttttcatttggtgatcagcactagaacacagagactcacagtggtaggtttgggctgagtcgtttgggtttttcctttgtttgtttattttacgaaggttcgtcctaggtggtggaggtncgngtgtggggtagggtaggttcgggtaggggggagttaccgttttcgggtaccccgtacggtcccggttcgggggtaccggggttaccccgttggaaaccggtacccgtttcccttcccggttggtaccgtacccgaccgttccccttccgtacggttcctaacctttacccgtaaccctttagaaccgtaccgaaacccctaaacctaaaacgtacggttcggggtaccgggttcccgggggttaccccgccggacggggtacccgtaaccgggggaaaggggggtaaccggggtggttaacgggggtcggggttaccggggttaccgggtaccggtttaaaacgtaaacggaaaacgggtaaacgtaacgtaaaacgttagtaaacgtacgtaaacggaagtaacgtaacccgggtcgtcggttagtacggttaaaggaaacgggttacgtacctaaccgtacgtaaccggtaagtaaacggtaagtaacgttagtaaaccgtaaacgtaaactaaccgttaacgtactttagtacctaacgtagtaacgtaanaacgaaacgaccggtaaaccgaaacggtaaaccgggacgaaccggtacggtaacgttagttaagtttaggttaaggtaggtaaaaggaagtaaaggtagggtaagttggttacgggttaggtacggttacgggtcgtaggtaacg

SEQ ID NO: 146018 - DNA, 759 bp, Homo sapiens
  misc_feature: GYAE6OF01A163X.21.4.A04.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcgaggggagagctgctcagttagacccagagggaaccatggaaaccccagccgcagcttctcttcctcctgctactctggctcccagctcagaaaccaccgganaaattgtgttgacgcagtctccaggccaccctgtctttgctccaggggaaacngcccacctgtcctgccagcctccagccagaactnccagancctactacatcgcctggtacccagccagaacgtcctggccaggccttcccgaggtttccncgtatcctatcggctcgggtaccacgtacgggccctacgtgggccacgttccccgaaggtaccgtaaggtttccaacgggtttcgggacccgtaagggtttcggggtcctacgggggtaaccctacgggtaacctttacccgtaaccttccggtttaccaacgttacctaacgtttaacggccgtaaacggtacccgtagggtaaccgtacccgttaggtaaacgtacgttttacggacgttacgttaacgttactttacgtaggtaccgtaagtacgtaacgttacggtacgggttaaccgtttacccgtaacccgtttcgttaccggttccggttacggtaaccccggtaaacgggtacccgtaaaaggggttaaccgaaaacgttaacggtaaaacccgttaacggttacggttacggtaccgttacggaacctaccgtagttcccgtttaaccg

SEQ ID NO: 146019 - DNA, 770 bp, Homo sapiens
  misc_feature: GYAE6OF01EDKU4.21.4.A04.1.454.CMB.1.raw
  modified_base (101)..(101): a, c, t, g, unknown or other
  misc_feature (101)..(101): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcagggggagagctgctcagttaggacccagagggaaccatcggaaaccccagcgcancttctcttcctcctgctactctggctccaggctcaacgaaaccgaccggagtaaattgtgttgacgcacgtctaccacggcctacctgttcttcgtctcgaaggggaancgaccacctctccagcacgctaccagtaccataacgtactacaacgagtacctaacgtacacgtacgtaccgtacggtaaccaacggtacaacggtaaccgtccgtacggaccgaccggtaccttaccgtaccggtttcctacgtacgttcgttagtccggtaccgtaccgggtacccgaccggacgggtccctaacggtcggaccgtaacctaccgtacggtaaccgtacgggttacggacggtacggggtcgttaacggggttcgggtaagggttaccggtacctaaccggttacctttacgaccgttacttaacctacgttacgtaagttaccgacgtaaggtaccgtaacggtactaaccggtaacgtacggttactaggtacgttagttagttacttacgtacgtacgaatcgtaacggttacgtagggttaacctccgttaccgttcgtacggttacggtaacccgtacgggtaaacggtaaccggtaaggtaaacgtaagtaaacggaacgtacgtaggtaccgttacaccggtactccgtagtccgttacgg

SEQ ID NO: 146020 - DNA, 833 bp, Homo sapiens
  misc_feature: GYAE6OF01BP75T.21.4.A04.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggtaggtttgggctgngtcgttgggttttccttgttgttattttacgaggtgtctagtgtgaggtgnagtcgtgggtggagtcggtggggatacgttcggaccaggccgtgggacgggtccctaggacgtaccttccgtcgtagtgccgacgtcccttcgtgtaccgttactttccctaccgtttcgaaggttacccgaaaccccaaccgtaaactacggggttacgggtaccggtttcccgggggaccccgccggtaacgggccgtaacccggggaaggggggacgggtcgtggggtacgggttcggggtaccggtacgttaagtaaacggaaaggaacgttacgtaaacgtagtacgtaagtacgaagtaagtccggagttcgtagtacggtaaggtaacgggtacgttaccaacctagttccgtaagaaaggtactagttacgtaacttaacgaaacgttaactccgaagtttagtacttccgtaagtaactaaacggttaacaaaccggaccggtaaacccgtaaaggaaaaccccggggacgttaaccgggtaacccggttggggtttaaactttagtttaaaccgggtttagggtaaacggttaaaagggaaaacggtaaaagggttcgggtaagggtttaagggttacggggtttacggggtaacggggttttcgccgggtttaagtaaccggg

SEQ ID NO: 146021 - DNA, 781 bp, Homo sapiens
  misc_feature: GYAE6OF01C2ML3.21.4.A04.1.454.CMB.1.raw
  modified_base (626)..(626): a, c, t, g, unknown or other
  misc_feature (626)..(626): n is a, c, g, or t
  modified_base (753)..(753): a, c, t, g, unknown or other
  misc_feature (753)..(753): n is a, c, g, or t
tcagtcgtcgctcgcacgaccggtgctcgatttagagtagtgatcagggggagagctgctcagttaggacccagagggaaccatcggaaaccccagcgcagctttctcttcctcctgctactctggcctcccaggcctacgaacgaacccaccggaataaagttgtgttcgacgcagtcctccgacggtcctacccttgttctttcgtacccgtaccggaacgggggaaacgccgcccctaaccccttccgtcccgtacggccacgtcccgtacccgaacgacccgtaagtaaacttaccgtaccgagtacgtaccttaacaacgtagtacgaccgttaggtaaccacgacgaacggaccgttcccgacggccaccggtcctaccccggtaccgtttaccacgtacctcttacggcgtccggttacccggaccacggtcggtacctacgcgacctacctaccggtagtacggtcggttacgaggttcggacgttacgggttgggtaccgacggtacctacggttacctactccgttactacgtacttacgtactacggtacgtacgtacggtacgtacgttacggtaacgttacgttccgtacgtagttacgttacgttacttacngttaccgagtaggtaaggtagtacgttaccgtaccttacggtcggtttacggaccggtaccgaacggtaaacccgggtagttaaaccggtaagtaaacgttaaccgaaggttccggtacgttaccgngtaccctacgtccttacgttcctacccg

SEQ ID NO: 146022 - DNA, 927 bp, Homo sapiens
  misc_feature: GYAE6OF01EYAGC.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagtcgttgggtttttccttgttgtttaacttttacgaaggttcgtccgagtgtgaggtgcgagtcgtgggtggtagtcggtagggggactacgttggtacccacggtccgtagggacgggttcccctaggacgtaccttccgtccgtgtcgaccgtacggtccgttcgttcgaccgttaactttaccctaccgtttaccgaacggttaaccgaaacccctaaacgaaaccgtaggttcgggtaacccggttccggggttaccccggacccggagggtaccccggtaacccgggtaaggggggaaccggggtccgtagggggtacgggtccggggttacccggaaccgttttaacgttaaacgggaaaaggtaaacgtacgtttaaaacccgagggtttaaccaacggtaaacgaacggttaaacggccgggccgttcgttacgtaagggtaacggaaagggttaccgttaaccctacgtaacgtacggtaacgaaagggtacgtaacgttaacgtaaaccgttaacgaaaccgtaaccgttaccgtaacgtttcggttaaccgttacgtaacgtaaccaaaccggttaacgtaaacccgaaccggtttaaaccccggaaccggtaaaaaccgggtcccggaaaccggttcccgggtaaccgtttaggtttaagttaacgggtttacggtaaacgggtaaaccgtaaaaggtaaaccggttaggggttaacggaaggtttacggggtaacggttacggttacgtaacccgggttgtaaacccgg

SEQ ID NO: 146023 - DNA, 957 bp, Homo sapiens
  misc_feature: GYAE6OF01C2PSX.21.4.A04.1.454.CMB.1.raw
  modified_base (148)..(148): a, c, t, g, unknown or other
  misc_feature (148)..(148): n is a, c, g, or t
  modified_base (205)..(205): a, c, t, g, unknown or other
  misc_feature (205)..(205): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctccaggctcacgaaccaccgganaattgtgttgacgctagtctcgacggcctaccctgttctttgcctcgaaggggaacncgccacccgtctccgtacgcacgtacctaccaacgaccgtaagtaactacgtacccgaagtacgtactaacctacgtagtacgtaccgttacggtaaccgagtaccgtaaggaccgtccggtcggacccggacggtccccgtacccgtacggtttcccacgtgttacgtacgttacggtccgttaccgggtacccacggaccgggaccctacggtcgactaccgtccgtagaccggttacgtacggtacggtacgggtcgtacgggtttaccgggtcggacgggtaacctacggttacccgttacgtaaacccggttccgttaactaacgttaccgtaacggtttacccggacgttaacggtaccggttacgggtaccgttaacccgggtaagttaaccggtttaaccgggtttaccggtaccgttaagggttttaccgtttaacggtttaacccgtttaacggaccggtaacggtttaaccggtaaccgggtttaaacggtttacggggtaaccccgtttttacccggttacccggtttaccgggttttacccggggttaacccggggttacccccgggttaaaacggggaaaaccccggggttttaaagggtaaacccgggtttaaaaaggtaaaacccggtttaaaccgggggtaaaaccggttaacccggttaacgggggttacccggtaaccggttaaacccgtccccggtttaaaccgttaccgggtttcccgttttaaccccggg

SEQ ID NO: 146024 - DNA, 764 bp, Homo sapiens
  misc_feature: GYAE6OF01C1ISK.21.4.A04.1.454.CMB.1.raw
  modified_base (136)..(136): a, c, t, g, unknown or other
  misc_feature (136)..(136): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactacaccagtggngtttgggctgagtcttcgggtttttccttgtttgtttattttacgaaggttgtccagtgtggagtgcaggctggtggagtcgtggggagtactggtccagtccgtggacggtccctgacgacttcgtcctgcgcgagccttcgtagctacttccaccttcaggtacacccaanaacagtacggacgtaccgggtcccgaccgagggcctacccggaaggggacggggtacctggggaacgggttcggggtaccggtaccgttaaagttaaaccggaacggtaaaaggtaaccctaaacgtacgtttaacgaaagttaccgaaggaaacgttccggaacggacgtttacaggtaaggtaaagggtaacggtttacaaccgtaacgtcgtaaaccgtaagacggtaaagttaacgtaagtttaaccaaaacggttaaccgtaacgtaaccgtttaacggtacttaacgttacgtaacgaaaactaacggtaaaccgaaccgttaacccgaaggaaaaccccgggtaacgaccgtaaaccgggtacgttacggtaaagtttaagttcggtaagtaagtaaccgaaaggtagtacggagtttacggagggtacgttaaggccgtagggtacg

SEQ ID NO: 146025 - DNA, 849 bp, Homo sapiens
  misc_feature: GYAE6OF01EJFOK.21.4.A04.1.454.CMB.1.raw
  modified_base (833)..(833): a, c, t, g, unknown or other
  misc_feature (833)..(833): n is a, c, g, or t
tcagtcgtcgctcgcacgaccggtgctcgatttagagtagtgatcgagggggagagctgctctaggttacggacccaggaacgggaaccagtacgggaaaccccccaggccgcagtcttcctcttccctccttgcctactctggcctcccaggcctacaacgaaaccgaccggtagtaatttggtgttacgacgctacgtcctccgacggtcctaccgttgtttcctttcgtaccggtaacggaagggggaacgtaccgtcccctaccccttcgtccgtacggcctacggtccctaccgacgacctaagtactacctaccgagtacgtaccgttaaccgtaacgtacgtaccgtccgttaccggtaaccgacgtaccgaaggaaccgtccgtacggtacccgtacggtccccttccggtaacggtttcccactacgtttaccgtaacggttcccggtaccggtttacccggggaccctaccgggtaccggtacccgtaccgggtacggaccctaccggtacccgaacggtaccggtacggttcgacggggtcggacggtacggttcgggtaccgtacgggactacgtccttaccggccttacgtagtacgttactacgtcgacgtacgtacgttgacgtacgtaaggtacttcgttagacgttacgttcgttaacgttcggtagactacggtacgtaaggtttacggaacgtttaccgtacccgttacggttgttacccgggttaccggtacgggaaaccgttaacgggaacgttaaagggtaacgttaacggtaaccggaccgtaggttccgacgtacgttacaccggtttnttaactccgttaaccg

SEQ ID NO: 146026 - DNA, 734 bp, Homo sapiens
  misc_feature: GYAE6OF01C32CQ.21.4.A04.1.454.CMB.1.raw
  modified_base (167)..(167): a, c, t, g, unknown or other
  misc_feature (167)..(167): n is a, c, g, or t
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
  modified_base (569)..(569): a, c, t, g, unknown or other
  misc_feature (569)..(569): n is a, c, g, or t
  modified_base (578)..(578): a, c, t, g, unknown or other
  misc_feature (578)..(578): n is a, c, g, or t
  modified_base (586)..(586): a, c, t, g, unknown or other
  misc_feature (586)..(586): n is a, c, g, or t
tcagtcgtcgctcgcacgaccggtgctcgatttagagtagtgatcaggggagctctgagagcggacgccccagccccagaacttcccaggttgttttcagtttggtagatcagcactgaacacagagactcaccatggagttggctgagtcttgggttttcctgttnttatttacgaagtnactagtgtgagtgnagcgtggtaggagtcggtaggggactatcggtccagtccgtaggacgggttcccagacggtactgtaccgtgtcgactaccggccttcgacgtactaacttacctaccgtttanaaccggttaccaaccaataacgacggtttaacggaaccgttggggtaccaccggtaaggacccttaacccggggaaggggtaaacggggaccgtttcggggaagggtttacccggggttacgggaacccttttaaagaaccgggaaaaggtaaactacgtaaacctagtaacgtaaacgtagaaacgacgttaccggccgtagtcgtaaaggaacggtaaagtaaggtttaccaacgtatacgaacaagttaggaaactnaaacgttanaaacgtanacgagtactattacgacgtaaacaacttacgaaagtaccgaactaaacggaaaccggagtaacgacgtacgttaacggtatacgtaggttacggaaattaacggaaagacggttagaagttggtacggtaggtagtccgtggtaaccg

SEQ ID NO: 146027 - DNA, 806 bp, Homo sapiens
  misc_feature: GYAE6OF01EYQJ5.21.4.A04.1.454.CMB.1.raw
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
tcagtcgtcgctcgcacgaccggtgctcgattttagagtagtgatcaggggagagctgctcagttaggacccagagggaaccatggaaaccccagcgcagtcttctcttcctctgctactctggctccaggctcagaaaccacggagaaattgtgttgacgcagtctccaggtccaccttgtctttgctcgaaggggaangccacctgtcctgcctagctaccagtccaagaactatccagacncttanaccatacgccttggtacccagccaaggtaacgccttcggacctaggtaccttacccgaaggtttccctacgatttaccgtagtcgggcttacggggtacccaacggtacggggcctaacgttcgggactaaaccggtccctaggaacgtacgggttcgtaacgggtgggtaaccgtacggggtttcgggggttcttaaccgggggactaaacggttaacttttacccgaccgttttacgtacggtaacttcgtaaacgtttacggaccgtaaggtaccggtaggtaaccgtaccgttaaggttaaagtaacgttttcgacgttagtttacggttaactttcgttacgtacgtaacggtaccttaaggttaagtacgggttaaacggtttaccctaacccggtttcgttaccgggtttaccgttacccgggggtaacccgtaaacggggtaaacccgtttaaaacggggtaagttaaaacggttaacgtaaaacccgggttaaacgttcgggttacgtaacccggtactaacccggaactttacggttccgtttaccg

SEQ ID NO: 146028 - DNA, 701 bp, Homo sapiens
  misc_feature: GYAE6OF01DMB3W.21.4.A04.1.454.CMB.1.raw
  modified_base (525)..(525): a, c, t, g, unknown or other
  misc_feature (525)..(525): n is a, c, g, or t
tcagtcgtcgctcgcacgaccggtgctcgatttagagtagtgatcaggggagagctgctcagttaggacccagagggaaccatggaaaccccagcgcagcttctcttcctcctgcttactctcgctcccaggctcagaaaccaccggagaaattgtgttgacgcagtctccacggccaccctgttctttgtctcgaagggaaacgcgccctaccctctcctcgcacgtcctaccacgaccaagtaactactaccgaagtacggtactaactaacagtactaccgttacgtaccagtacaagaacgtccgcggaccacgggtcctaccccgttacggttcctactacttacgttacgtcggccgttaccgggccacggaacgccgacgtcggaccacgtccaaggtacgtacggttcgaggtcgcgtacggtcggtcgtagggactacgtcgttaccgcttacctacacttactacgtttacgacgtactacggtgtaaccgtacgtagtaacgttcgtttacggnttaagggttcttaacgttacgttacgtagtacgtcgtaaggttacggtacggttaacgttccttaaccgttcggtacgtttaccgggtacggtaaccggtaaggtaaccgtaaaggtaacgtaaaggtacgggtaaactacggtagacggtaactcggaacacgtccgttgttacc

SEQ ID NO: 146029 - DNA, 847 bp, Homo sapiens
  misc_feature: GYAE6OF01B9WYR.21.4.A04.1.454.CMB.1.raw
tcagtcgtcgctcgcacgaccggtgctcgatttagagtagtgatcaggggagagctgctcagttaggacccagagggaaccataggaaaccccagcgcagcttctcttcctctgctactctggctcccaggctacaacgaaaccacggaagtaaattggtgttacgacgactacgttcctaccgaggccctacccgttgttctttcgtacctaccgggaaaggggaaacgcgacccctacccgttctcccgtcgaccacgtccctaccgaccgacctaagtaactactaccgaggtactacctaacgtacacgtacgaccgttacggaccaggacgaagaccgccgtcggtaccgacggtccctaccggtaacgttcctaagtacgttacgtcgtccggtaccgggtacccggtacccgacggacccggtactacggaccgtaccgtaaccccgtacccggtaacggaaccggttcggtttaagacgggttcggtaacggtcggggttacgggttaccggaaggaacccttaaccgttaacctttaccgtacctaccgttacgtaaagtacccgttaagtacccgtaccggaacggttacgggtaacggtaaccgttaaccggttagttaaaccggttccgtaacgtacggttacgtttacgtacgtttacgcgtaagtacgtacgttaggttacgacgtttaaccgtcctttacggcgtttacccgggtaccggttaacgggtaaaccggaaccggttaaaacgggtaaagtaaacgggtaaaccggtacggtaaacgtttacggtccgtaacgtccgtacgtacccgaactttcggtacgttccg

SEQ ID NO: 146030 - DNA, 854 bp, Homo sapiens
  misc_feature: GYAE6OF01CKSPB.21.4.A04.1.454.CMB.1.raw
  modified_base (175)..(175): a, c, t, g, unknown or other
  misc_feature (175)..(175): n is a, c, g, or t
  modified_base (363)..(363): a, c, t, g, unknown or other
  misc_feature (363)..(363): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttggtttccttgttgttatttacaggtntcagtgtgagtgcagctggtggagtcggtgggggagtacgttggtacccaggccgttgggtacgggtcccctgacgtaccttcctcccgtgtcgaccgcggtccccttcgtacgtcctacttaccctacccgttttcaaggtccgaaccctaccaaacgttggtacgggtaccgtccggggttccccnccgggaacggtcccgttaaccggggacgggggaacggggtcgttacgggggagggtttaccggggccgggttacccggttaaagtttaacccgggaaaagggttaaccgaaacccgttaaaacggtacggttaaaccgtaacggttaaccggaaacgtaaaccggggtccgggacccgtttaccggtttaccggtaaggggttaaccggggtaaaaacggggttaaccgggtttacccgaaacccgttaacgttacccgtaaccggtaaaggtaacgtaggttaacgtaacgttaaaccgtaaaacgttaccgttaactaacggtttacgtaacgttacgtaggtaaactaacgtaacgtaaaccggaacgtaccggtaaacgaaaccggtaacggtacccgacggtccgttagtacttacggttaggttacggtaagaacgtaaagggtcgtaggaggttcgggttaggtagttggccgttcggtaacgg

SEQ ID NO: 146031 - DNA, 858 bp, Homo sapiens
  misc_feature: GYAE6OF01AV989.21.4.A04.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (210)..(211): a, c, t, g, unknown or other
  misc_feature (210)..(211): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacgganaaattgtgttgacgcagtctccaggcaccctgtctttgctccgaggggaangccacctctccnncagctccaagccaagtaaactactccgaaggactacttaactaacaacgttacggacccgttagggtaacccaaggcaaacggaaacggtccctcggggacccaagggtccccttacccgtaaccgggtttccctaccgtaagttccttaacggtccgaccggtttaccgggggttacccccaaggaaccggggtcccaaggtacgggtacctaaccgtccccggaaggtaccggtaacggtttccgacgggttagggaccccgtaaggggttcgggtaccggtaggggaaacctagggttaaaccctttccgaaacgttcctactacgtaccgtaagttaaccgcgaacgtacggtagggaccgtccgtaagtaaagttcgtttacgcggttaacgttcgttaacgtttcggtacgtaccgtaacgtaccgtaagttacgggttaaggttaaacccgtttccgtaaacctttccgggtttacggtccccgggttttaaaccgggacccgggttaaaaaccgggaacccggttaaaggggttaaaccgggtaaaacgttaacgggtaaaaccggaaacgggtttccgggttaaaccgggtaccgttaaaccgacccgtttaaaccggcgttttaacccgttaccggg

SEQ ID NO: 146032 - DNA, 767 bp, Homo sapiens
  misc_feature: GYAE6OF01E440I.21.4.A04.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (244)..(244): a, c, t, g, unknown or other
  misc_feature (244)..(244): n is a, c, g, or t
  modified_base (467)..(467): a, c, t, g, unknown or other
  misc_feature (467)..(467): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaaccaccgganaattgtgtgacgcagtcctccgagccacctgttctttgcctccggaggggaaanacgccctaccctctcctgcgacgcctccagccaagaacttacnccagacgtctaacacagtacgccgttacgaccagtaccgacggtaacgcccgtacgggcccacggtcccacccgttcgttacctacacttctgtcgtccgtccggtacccacggaccgggaccacggtcgtaccacctcccgaaggtacgttggttaccggaggtcggacggtacgggtttcgggacgtcgggaactacgttaccttccgaacttccgaactnttacgaacgttacgacgtacgtaccgtcggactacgtagttaacgttacgttaccggtaccggttagtttaaccggtacgtttacgtacggttcgtaaaggtcgttaacggtacttaccggggttaacctttacccgttaaccgttttcgtttaccgggttaacccggttaccgggaaccggttaaaccgggaaacccgttaaaggggtaaaccgtaaagggaaacccgggttaaaaccgtaccggttacggaacccggttcctaacggtaccctaaccgtttacgtcccgtttacccgg

SEQ ID NO: 146033 - DNA, 709 bp, Homo sapiens
  misc_feature: GYAE6OF01DQEDX.21.4.A04.1.454.CMB.1.raw
  modified_base (159)..(159): a, c, t, g, unknown or other
  misc_feature (159)..(159): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
  modified_base (496)..(496): a, c, t, g, unknown or other
  misc_feature (496)..(496): n is a, c, g, or t
  modified_base (521)..(521): a, c, t, g, unknown or other
  misc_feature (521)..(521): n is a, c, g, or t
  modified_base (568)..(568): a, c, t, g, unknown or other
  misc_feature (568)..(568): n is a, c, g, or t
tcagtcgtcgctcgcacgaccggtgctcgatttagagtagtgatcaggggagagctgctcagttaggacccagagggaaccatacggaaacccagcgcagcttctcttcctcctgcctactcgtcggcctacccaggcctacaacggaaccaacggtanaaattgtgttcgacgctagtcctaccgaggcctacctgtcttgctcgaagggaancgcctaccgtctaccnggctagtcctaccgagacctaagaactacgaccgtagaacgtactaacctagtacggtagtaccgttaggaaaccngaaacgacggtaaccnccggtacgaccgaaccggttccacccgttacggtttacccagtactacgtaagtcgggtccttaaccggacccgaacgggtgaccctaggacggtcctaaacctccggaagtaccgtgttacgagtggaccgtaggttcggaccgtaggacctgtaccctctaactcaaacgtntacgtagtacgaacgtacgtaacgngtacgtacttaaggtactttacgtactagtagttaagttactacgtntaccgtacgtaacttaggtaacgtagtccgttactacgttcgttagtccggtaacggacgtacggggaaactaggtaaaataaccggtacgtaaagtaccgttcgaacggttctaactcccgaaattccggttctaaccgg

SEQ ID NO: 146034 - DNA, 829 bp, Homo sapiens
  misc_feature: GYAE6OF01B2MJF.21.4.A04.1.454.CMB.1.raw
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctgagcgttggttttccttgttgttatttacaaggtgtccagtgtgaggtgcagcgtggtgagtcgtggggactacgttggtccaggccgtgggacgggtcccnggacgtacctccgtccgttgtcgcgacgccctctgacctattcctaccttcgagtccgaacccactaacnggtacggaccgttcggggtacccaccgtacggccgtaccggaagggggacggggtcgtagggtacggttcggggtccggtaccgttaacgtaacgaaacggtaaacgtacgtaaacgtagtaacgaacgtaccaaggtaacgtaccgggccgtacgtcgtaggtaacggtaaacgggtacgttacccgaccgtaacgttaccgtaacggaaagtacgtagttacgtaaaccgtttaacaaaaccggtaaccttacctaaccggtttacgttaacttaaccgtacggtaaaccttaaacgacggtaaaacccgtcgggtaaaaccccggtaaacggtaaaaaccccgggccgggttaaaccgtaccggggttacccgtttaaaggttttaaccgtttaacggtttaagggtaaaccggggttaaaaggaaaacccgtaaaaggggttccggttaaagggttaacgggttcgggtttaggggtaaccggttacgtacggtaccggttaacccgg

SEQ ID NO: 146035 - DNA, 843 bp, Homo sapiens
  misc_feature: GYAE6OF01BGAG6.21.4.A04.1.454.CMB.1.raw
  modified_base (184)..(184): a, c, t, g, unknown or other
  misc_feature (184)..(184): n is a, c, g, or t
  modified_base (808)..(808): a, c, t, g, unknown or other
  misc_feature (808)..(808): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggtagtttggctgagtcgttgggttttccttgttagtttatttacgaggtntcagtgtgaggtgcagtcgtggtggagtcggtaggggatacgtttcggtccgaggtccggtagggtaccgggttcccctaggaacgtaccttccgtccgtggtccgacgtacggtcccttacgtcgtaccttacctttaccgtaacccgtttcgaacggttaccaaccctaaacaaaccgttgggttacgggtacccggttccggggtacccgacccggtacgggtcccggtaacccgggaagggggggtacgggtccggttagggggtaacggggtttccggggtaacccgggttaaccggtttaaaggtaaacccgggtaaaaagggtaaccgtaaccgttaaaacgttacggtaaaacctaagggtaaaccaagggtaaaccgttaccggggaccgttccggttaacggtagggtaaaggggtaaacgggttaccggttacccaaccgtagtttaaccgaaccggtaagtaacgtagttaaccgttaactaaacgaacctaacctacggttaacttgttaacctgaaaccgtagtaagaacgaacacggtacgaaacggaacgacggtaccgtacggtgttaagttacggttaattacgggtaagaagaaacgtaagggtntagggtagttggtacggtaggacgttgtacgtacg

SEQ ID NO: 146036 - DNA, 896 bp, Homo sapiens
  misc_feature: GYAE6OF01ERC70.21.4.A04.1.454.CMB.1.raw
  modified_base (147)..(147): a, c, t, g, unknown or other
  misc_feature (147)..(147): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccacgganaattgtgttgacgcagtctccgaggccacccttgttctttcgtcgtaccgaagggggaaacgacggacccctacccgttcctaccgtggacctacgccgtcccaacggaccaagtaaacttaacgacccgaaggacgtaccttaactaaccaacgttaccgcccgttacggtaacccacggaaccaaaggaaccggtcccgtagggaccccgacgggtccccttaccccggtaacggtttccctaacgtaacgttccgttaagtcggtaccggttaccggggtaccccacgggaccgggtaccctacggtacggacctaacctacccggaacgtaccgtaacggttacgaacgggttcggacggtacgggttcgggtccggtaacggaacgttaaccggtaccttaccgtaccttaccgttacgtaaccttacgtaatttaaccgggcgtaacggtacggtacgggaacgtacggttaacggtaacgtttacggtttacgacggttaagttacgtttaataccgtttaggaaccttacgggaaccgtttaaggtaagggtttaaccggttaaccgtttacccgttaccggttaccggttaccggtttaccgggttaacccgggaaaacggttaaacgggggtaaaacccggtaaggttaaaccggtaaaaggttaacggaaaccggttacggtaacgggttaccgggtaccaacgggttaaaccacccgttagttaccgttaaaccccg

SEQ ID NO: 146037 - DNA, 972 bp, Homo sapiens
  misc_feature: GYAE6OF01BNKZO.21.4.A04.1.454.CMB.1.raw
tcagtcgtcgctcgcacgaccggtgctcgatttagagtagtgatcaggggagagctgctcagttaggacccagagggaaccatcggaaaccccagcgcagcttctcttcctcctgctactctggcctcccgaggcctcaacgaaacccgacggaagtaaatttggtgttgacgctacgtcctaccgaggcctacccgttcgttctttcgtaccgtaccggaaaggggaaactacctcccctacccttctccgtcgcgactcctaccacgaccaagaacttacaccgaagacgtaccttaactactagtacgtccgtacgtaccagacaacggaccgtcccgtggacccgtacggtcccttaccggtacgttcctacgtacttcttacggtcggtccggttaccgggaaccctacgggaccgggtccctacggttccgaacctaccgtaacccgaaggtaccggttacggttacggaacggtcgggacggtacggggttcgggttaaccgggtgggaaaccgtacggtttacccttaccgtacctttaccgttacgtaaacccgttaggttaaccgtaacggggtcggttaaacccggggttaccgggggtttacccgggtaaaccgggttaaccggttaaacgggttacccggttttaaccgggtccgggttaaagtttttaacggtttaaccgttttaaccggtttacggttaaccggttaccggtacggtttaaacgggttacgggttttaaacggtaccccggttttaacttccccgggttttaacgtcccgggggttttaccccgggtaaaccggggttaacccggggtaaaacgggtaaacccgggtaaaaggttaaaaacgggtaccggtaaaaaccggtttaaaccgtagggggttacggttacccgggttaaccgaccggtttaacccgaaccgtttaacgttcccgtttaaaccggtttcccg

SEQ ID NO: 146038 - DNA, 808 bp, Homo sapiens
  misc_feature: GYAE6OF01CKI42.21.4.A04.1.454.CMB.1.raw
  modified_base (794)..(794): a, c, t, g, unknown or other
  misc_feature (794)..(794): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgggtagtttgggctgagtcgttgggttttccttgttgttatttacaaggtgtcagtgtgagtgcagcgtggtggagtcggtgggggataccgttgggtaccacggccgtggggtacgggtccctggacgtcctccgtccgtgtacgctaacgtccctgtcgtaccttacttcctaccttcgacgttacgaaccacaacagtcggtaccgtcgggtcccgaccgacggccgtaccgggaaggggtaacggggtcgtaggggtaacgggttcggggtacccgggtaccggttaaagttaaccggaaaggtaaacgtaccgtaaaacgtacggttaaccaaggtaaccaaggtaaacggtccgggaccgtacgttcggtacggtaacgggtaaagggtaccgttaccaaaccctagttacccgaacgaaaggtagtaacgttagtaacctaacgaaaacgttaacctaccgtaaacgtttaagttacctacgtaacgtaaactaacgtacggaaaaccggtccgtaaccggtaaaccgggaaaccggtaacgggacccggtaaccggtaccggtttaagttaacttgggttaacggtaacggaaacgtaaacggaaaaggttgggttaaacgggtggttacggggtttacggagggtttaccggngtttacggggtaac

SEQ ID NO: 146039 - DNA, 755 bp, Homo sapiens
  misc_feature: GYAE6OF01A4DVZ.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctcaggccacccttgttctttcgtctaccgaggggaaanactccctacccgtctccgtgaccacgcctaccgacgtaccgaagaacttacctaccgaagtacgtaccttaaccttaacgtaacgttacggacccgttacggtaacccgaacgaccgaaacggtaaccggtacccgttacgggaccgaaccggtccctaccccggtaacggtttccctactacttcgttacgtcggtccgttacgggtaccccgaaggaccggacccgtacgttcggacctaccgtacccgaagtacgtacggttacgaggtcggcgtaggtcggtcgaggtacacgtacttcacgtctactactcgtagttacgactaggtacgtaggacgtaccgtaagtaacgttacgttacgacgttacggttacgttaactttacggtacgtaccgtaaggtccgttaaaggttacggtaacggttaacgtttccctaccgttacggtacggttaccggtaccggtaccgtaagggtaaccgtaaaggtaacgtaaagtacggtaacgtacgttggtacgtactacgactactgttccgttacg

SEQ ID NO: 146040 - DNA, 670 bp, Homo sapiens
  misc_feature: GYAE6OF01B4VI2.21.4.A04.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (655)..(655): a, c, t, g, unknown or other
  misc_feature (655)..(655): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccaccgganaaattgtgttgacgcagtctcaggcaccctgtctttgctccgaggggaaangccacctctcctgcagctccagccaagaactactccgaagagtctaactacatacgcctaggtaccagacaagaacgcctggaccaggtcctcccgaggtttcccatattccgtaagtcggtccgttacggggtaccccaaggtacggggccctaacgtcgggacctactaccccgaaggtaaccgtaggtttccaaggttcgggacgtagggttcgggtacgtacgggacacgttacctttctaccgtctactacttacgtagttacgcgtaagtaacgtggacgtccgtaggaacgttacgtttacgacgttagtttcgtaactttacgtgtacagtaccgtaagttagtcggtaacttccgtacgttcgttacggttccggtaccggtaaccgtaacggtaaccgaaaggttaacgaaggttaacggaaactacgtggtacgtgtacggaacnccgttagtcgttacg

SEQ ID NO: 146041 - DNA, 928 bp, Homo sapiens
  misc_feature: GYAE6OF01BY0RG.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccgaccggaagtaattgttgttcgacggcagtcctccgacggcctacccgttgttcctttcgtccgtaccggaaggggaacgccgccctacccttctccgtgccacgtcctccgacgaccaagtaactactaccgaagtacgtacctaacctactaacgtaccgtaccgtacggtaaccacggtaccgaaggtaaccgtccggtacggaccctacgggtaccccttaccggttaccgttaccctataccggttacttaacggtccggtccggttccgggtaaccccgaagggtcccggactaccggtcggacctaacccgtacgaaccggttcgttacgggttacgtcgggacggtacggaggggtttccgggtaccggtaacgggtacctaacgttaccttccttaaccgtcgttacgtaaccgttacgttaacgtacgggaaccgtacgggtaaccgttacgggaaccggttaaccggtacggttaaccggtttacggtttacggtacggttaacgttttacggttaacctttaccgggttcgtaaaccggtacggtacgtttaaaggttaccgggttaacgggtttaaccctttacccgttaacccgggtttacgggtttacccgggttacccggggttaacccggggtaaaccggtaaaccggggtaaaccgggttaaaacgggtaaacgttaaaaccggtaacgggttaaaaccggggtcgttaccgggttacggtacccggttaaccgtaaccgttaacccgtttcgttacgttttaacccg

SEQ ID NO: 146042 - DNA, 813 bp, Homo sapiens
  misc_feature: GYAE6OF01ESK08.21.4.A04.1.454.CMB.1.raw
  modified_base (120)..(120): a, c, t, g, unknown or other
  misc_feature (120)..(120): n is a, c, g, or t
  modified_base (159)..(159): a, c, t, g, unknown or other
  misc_feature (159)..(159): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcagggggagagctgctcagttaggacccagagggaaccatggaaaccccagcgcagcttctcttcctcctgctacnctggctccaggctcagaaccacggataattgtgtgacgnagtcacaggcacccttgtctttcgctcgaagggaancgccacctctcngcagtctccagcagatacgtccganacgctactacagtacgcctacggtaccaggacagtaacgccgtacggaccgacggtccctacccggtacgtttcccgtctacgttaacgttacgtccgggtccggttaccgggtaccccgtacggaccgggttacccaacggttcggaccctaccgttacccgaggtaccgttaggttacgacggtcggtacgtagggttcggtcgggtacggagtacggtacctttacgaccttaccgttactacgttacgtaagtttacgaacgtacggacgggtttaccggaacggtacccttaaggggaaaccgtttacgtacggtaacccgtttaaggttcgtttaaccgtttcggtaacggttaccgtagtaacgggttagtttaacggttacggttaacgttcccgtttaacggttccgttaacgggttcccggttaacccgggtaaccgggtaaaccgggggtaaaccgttaaacggggttaaacgttaaaacccgggtaaccggttaaaacgggtaccgggtttcgggtaacgtaccgggttacccaccctttaaaaccggttgttcccggttttaaaccgg

SEQ ID NO: 146043 - DNA, 495 bp, Homo sapiens
  misc_feature: GYAE6OF02I6YWG.21.4.A04.1.454.CMB.1.raw
  modified_base (201)..(201): a, c, t, g, unknown or other
  misc_feature (201)..(201): n is a, c, g, or t
  modified_base (395)..(395): a, c, t, g, unknown or other
  misc_feature (395)..(395): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccactggcatcccagacaggttcagtggcagtggtctgggacagacttcactctcatcattagcagactggagcctgaacgntttcgcagtgttattactgtcagcagtatggaagttcaccttctgtcgttcgccagggaccaaggtagaaatgaaacgacgtgtaggctagcaccatctg

SEQ ID NO: 146044 - DNA, 492 bp, Homo sapiens
  misc_feature: GYAE6OF02FLCXV.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccacctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcgccagggaccaaggtaagaatagaaacgaactgtaggctgcacatctcg

SEQ ID NO: 146045 - DNA, 497 bp, Homo sapiens
  misc_feature: GYAE6OF02IXREU.21.4.A04.1.454.CMB.1.raw
  modified_base (201)..(201): a, c, t, g, unknown or other
  misc_feature (201)..(201): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtagtgatcaggggagagctgctcagttaggacccagagggaaccatggaaaccccagcgcagcttctcttcctcctgatactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccacgtggcatcccagaccaggttcagtggcaggtggtctgggacagacttcactcncatcattagcagactggagcctagaagtatttcgcagttgtacttacgtgtcagctagtatggaagttcactctgtcgttcgcagggaccaaggtgaaatgaaacgtactggtggctcgcacatctg

SEQ ID NO: 146046 - DNA, 488 bp, Homo sapiens
  misc_feature: GYAE6OF02J2I1E.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacagggccactggccatcccagacaggttcagtggcaggtggtctgggacagcttcactctcatcattagcagactggagcctagaagtactttcgctagtgtattctgtcagcagtagtgagttcactctgtcgttcgcgaggacaggtagaatgaacgacgtgtggctgacacatctcg

SEQ ID NO: 146047 - DNA, 489 bp, Homo sapiens
  misc_feature: GYAE6OF02I0YQ6.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaagcctggccaggctcccaggttcctcatctatgctgggtccacagggccactggcatcccagacaggttcagtggcagtgggtctgggacagacttcactctcatcattagcagactggagcctgaagatttcgctagtgtattactgtcagcagtatggaattcacctctgtcgttcgccagggaccaaggtagaatagaaacgaactgtggctgcacatctcg

SEQ ID NO: 146048 - DNA, 500 bp, Homo sapiens
  misc_feature: GYAE6OF02HZTHF.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcaggtggtctgggacagacttcactctcatcattagcagactggagcctgaagatttcgctagtgtattactgtcagcagtatggaagttcaccttctgtcgttcggaccagggacctaaggtagaagtagaaacgtaacgtggtggctgcacatctcg

SEQ ID NO: 146049 - DNA, 170 bp, Homo sapiens
  misc_feature: GYAE6OF02G0700.21.4.A04.1.454.CMB.1.raw
  modified_base (167)..(170): a, c, t, g, unknown or other
  misc_feature (167)..(170): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagcgggctggcaaggcgcatagnnnn

SEQ ID NO: 146050 - DNA, 496 bp, Homo sapiens
  misc_feature: GYAE6OF02GYPYY.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccagacgggccactggcatcccagacaggttcagtggcagtgggtctgggacagacttcactctcatcattagcagactggagcctgaagtatttcgctagtgtattactgtcagcagtatggaagttcacttctgtcgttcggcctaggaccaaggtagaatagaaacgtactgtcggctgacactatctg

SEQ ID NO: 146051 - DNA, 558 bp, Homo sapiens
  misc_feature: GYAE6OF02IZ9MI.21.4.A04.1.454.CMB.1.raw
  modified_base (291)..(291): a, c, t, g, unknown or other
  misc_feature (291)..(291): n is a, c, g, or t
  modified_base (407)..(407): a, c, t, g, unknown or other
  misc_feature (407)..(407): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggcccaggctcccaggttccncatctatgctgggtcccacgagggccacgtggcactcccagacaggttcagtggcaggtggtctgggacagacttcactctcatctattacgctagacgtggacgccgtagaagtntttacgctagttgttacttacgtgtcgagctagttagtagggtaacttcaccttgttcgttccgttcggaccgaacgggacctaagggtaacgtaaagtacggtaaacgtaacgttggtacggtacgtacgaccgtaactacgtcgttacg

SEQ ID NO: 146052 - DNA, 530 bp, Homo sapiens
  misc_feature: GYAE6OF02JBNED.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggagagctgctcagttaggacccagagggaaccatggaaaccccagcacagcttctcttcctcctgctactctggctcccaggctcagaaaccaccggagaaattgtgttgacgcagtctccaggcaccctgtctttgtctccaggggaaangccaccctctcctgcagctccagccagaatactccagagctactacatagcctggtaccagcagaagcctggccaggctccaggttccncatctatgctgggtcccacgagggccagtggcatcccagacaggttcagtggcaggtggtctgggacagtacttcactctcatcattagcagactgganctagaagnttcgnagttgtacttactgtcagctagtatggaacgttcaccttcgtagtccgttcgaccgtagggtacctaagggtaacgtaaagtggtaaaaccgtacgttaggtacggacttgaccgtaacctactgtacg

SEQ ID NO: 146053 - DNA, 531 bp, Homo sapiens
  misc_feature: GYAE6OF02FR3ED.21.4.A04.1.454.CMB.1.raw
  modified_base (163)..(163): a, c, t, g, unknown or other
  misc_feature (163)..(163): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttcgtgtagtnttcagtgtcagtgtgagtgcagcgtggtggagtctggggganacttgggtccagccgtggagggtccctgagactctcctgtgcagcctntgcattcaccttcgagtgaccacaacatggactgggtccnccgaggctccgagggagggctggagtgggtcgcgtatacaaggtaanctaacngttacagtacagaatacggctcgtctgtagaaaggagttcacctatctacaagtagatgaattacgaaagtactnacttgtactctgactaaagtcgaacngacctagaaaacccgnggaccacggtctagtacttagtaggtggaagaacgaaagtcgtggatcggtggtagtagacgtgtacg

SEQ ID NO: 146054 - DNA, 544 bp, Homo sapiens
  misc_feature: GYAE6OF02I87VA.21.4.A04.1.454.CMB.1.raw
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctccaggttccncatctatgctgggtcccacgacgggccactggccagtcccagacaggttcaggtggcaggtggtctgggacagacttcacttctcatcattagcagactaggacgccgtagaacgtatttcgactagttagttattactgtacagcagttagtaggtaagttcaccttcgtcgttacgttcggaccgaacgggaccgtaagggtaacgaaagtacgaaacgtacgtaggtacggtactggaccacgtagtcttcg

SEQ ID NO: 146055 - DNA, 511 bp, Homo sapiens
  misc_feature: GYAE6OF02HMDL7.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctccaggttcctcatctatgctgggtcccanagggccatggcatcccagacaggttcagtggcagtgggtctgggacagacttcactctcatcattagcagactggagcctagaagtatttcgctagttgttattactgtcagcagttatggtaagttcacctctgtcgttcggcgaagggaccgaagggtaagaaataggaaacgtaacgtagtaggctgacaacctatctcg

SEQ ID NO: 146056 - DNA, 500 bp, Homo sapiens
  misc_feature: GYAE6OF02FVZV3.21.4.A04.1.454.CMB.1.raw
  modified_base (309)..(309): a, c, t, g, unknown or other
  misc_feature (309)..(309): n is a, c, g, or t
  modified_base (497)..(497): a, c, t, g, unknown or other
  misc_feature (497)..(497): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccanagggccactggcatcccagacaggttcagtggcaggtggtctgggacagacttcactctcatcattagcagactggagcctgaagatttcgctagtgtattactgtcagcagtatggtaagttcacctctgtcgttcgccgagggaccaaggtagaaagtagaaacgtaactagtggctgcacctatntcg

SEQ ID NO: 146057 - DNA, 502 bp, Homo sapiens
  misc_feature: GYAE6OF02HMZNS.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacgagggccactggcatcccagacaggttcagtggcagtgggtctgggacagacttcactctcatcattagcagactggagcctgaagtatttcgctagtgtattactgtcagcagtatggaagttcactctgtcgttcgccagggacctaaggtaagaagtagaaacgtaacgtgtaggctgactaccatctcg

SEQ ID NO: 146058 - DNA, 578 bp, Homo sapiens
  misc_feature: GYAE6OF02HP9P1.21.4.A04.1.454.CMB.1.raw
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
  modified_base (432)..(432): a, c, t, g, unknown or other
  misc_feature (432)..(432): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcggtgttcgtgtaggtcgttacaagtgtcagtgtgagtgcagctggtggagtcgtgggggagacttggccagcctggagggtccctgagctctcctgtgcagcctctgcattcaccttcagtgaccanaacatggactgggtccgcaggctccgagggagggctggagtgggtcggcctattacgaaggaaanctaaacagttacagtacagtaatacgggcncgtctgtaggaaaggtaggttacaaccgtatctacgaagagatgaattacgaaaagacctanacgttagtactctagacaaagtcgaacacgaccttaagaaaacccgagggacccaacgggaccgttagtacgtttagtttacggagggttagaaacgtaaaaggtaggtaggtacgtaggtagggttggtaagtccgtagggtacg

SEQ ID NO: 146059 - DNA, 509 bp, Homo sapiens
  misc_feature: GYAE6OF02GRAH9.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctcccaggttcctnatctatgctgggtcccacgagggccacgtggcatcccagacaggttcagtgcagtggtctgggacagacttcactctcatcattagcagactggacgccgtagaacgtatttcgctagttgttattacgtgtcagtcagtataggacgttcactctgtcgttcgacgaggactaaggtaagaatacggaaacgacgtgtcgcgtagactactatcgtacg

SEQ ID NO: 146060 - DNA, 486 bp, Homo sapiens
  misc_feature: GYAE6OF02GLTGW.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtggtctgggacagacttcactctcatcattagcagactggagcctgaagatttcgcagtgtattactgtcagcagtatggaagttcacctctgtcgttcgccaggaccaaggtagaatgaaacgactgtggctgcacatctcg

SEQ ID NO: 146061 - DNA, 497 bp, Homo sapiens
  misc_feature: GYAE6OF02HKJXB.21.4.A04.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccanagggccactggcatcccagacaggttcagtggcaggtgggtctgggacagacttcactctcatcatcaacacactggcgcctagaagtatttgctagtgttattactgtcagtatgtatggtagtcaccgtacacgttggccgagggacaaggtggagatcgagacgaacgtgtcggctgacaccatcg

SEQ ID NO: 146062 - DNA, 507 bp, Homo sapiens
  misc_feature: GYAE6OF02IPH69.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacgagggccactggcatcccagacagttcagtggcaggtggtctgggacagacttcacttctcatcattagcagactggacgcctagaagtatttcgctagttgttattactgtcagctagtatggtaattcaccttctgtcgtcgacagggactaaggtagaaataggaaacgacgtaggtcgacgtgacactatcgtcg

SEQ ID NO: 146063 - DNA, 515 bp, Homo sapiens
  misc_feature: GYAE6OF02HFQJI.21.4.A04.1.454.CMB.1.raw
  modified_base (456)..(456): a, c, t, g, unknown or other
  misc_feature (456)..(456): n is a, c, g, or t
  modified_base (489)..(489): a, c, t, g, unknown or other
  misc_feature (489)..(489): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccgagggagggctggagtgggtcggccgtatacaaggaagctaacagttacagtacagaatacggcgcgtctgtgaaaggaggttcaccatctcaagagatgattacaaagactcactgtatctgacaaatgaacagcctagaaaccgnggacacggcctgtattatgtggtagacaaaggngtaggatggtggtggtagcgtgtacg

SEQ ID NO: 146064 - DNA, 514 bp, Homo sapiens
  misc_feature: GYAE6OF02HMRAY.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctctcctgcagctccagccagaatatccagagctactacatagcctggtaccagcagaagcctggccaggctcccaggttcctcatctatgctcgggtcccacagggccactggcatcccagacaggttcagtggcagtggtctgggacagacttcactctcatcattagcagactggagcctagaagtattcgctagtgttattactgtcagctagtagtggtaagttcacttctgtcgttcggaccgagggacctaagggtaagaaatacggaaacgtaacgtgtacggctagacacctatctcg

SEQ ID NO: 146065 - DNA, 524 bp, Homo sapiens
  misc_feature: GYAE6OF02F6JPG.21.4.A04.1.454.CMB.1.raw
  modified_base (206)..(206): a, c, t, g, unknown or other
  misc_feature (206)..(206): n is a, c, g, or t
  modified_base (469)..(469): a, c, t, g, unknown or other
  misc_feature (469)..(469): n is a, c, g, or t
tcagtcgtcgctcgcacgaccggtgctcgatttagagtagtgatcaggggagagggctgctcagttaggacccagagggaaccatggaaaccccagcgcagcttctcttcctcctgctactctggctcccaggctctaggaaaccaccggagaaattggttgttgacgcagttctccaggcacctgtctttgtctccaggggaagngccaccctcgtcctgcagctccaggccagaatactccagacgctaactacattagcctggtaccagcagaacgcctggcccaggctcccaggtttcctcactctatcgcgttgggtcccgacaggggccacgtggccattcccagactaggttcagtggactaggtggtctgggactagacttcactctacgatctattacgcagactggacgcctagaagtatttcgctagtgttattactgtcagcagtatgagttcactntgtcgtcgcgagacgaggtagaatgaacgacgtagtagtctgacacgtatcgtcg

SEQ ID NO: 146066 - DNA, 650 bp, Homo sapiens
  misc_feature: GYAE6OF02JTD5T.21.4.A04.1.454.CMB.1.raw
  modified_base (294)..(294): a, c, t, g, unknown or other
  misc_feature (294)..(294): n is a, c, g, or t
  modified_base (560)..(560): a, c, t, g, unknown or other
  misc_feature (560)..(560): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaccaccggagaaattgtgttgacgcagtctccaggcaccctgtctttgtctccgaggggaaagagccaccctctcctgcagcctccagccagaatatccagagctaacacatacgcctggtaccagcagaagcctggccaggcctcccaggttccctnatcctatcgccgttcgggtccccaacgaggggcccaacgtgggacctacgtacccaggaacctaggttccaggtcgggctaaggggtttcgggtcgtcggggaaacaccggtaaccttttccgaccttcctttacgacgtactaatttacggacgtacgaccgttagggacgtacccgtaggtaaacggtattttccgaccgtagttacgttactttaccgtgtaccgaggtactacggttagtagggtaacgtttccaaccgttntcggttcgttacgaccgacggggtacctaaggggtaacgaagtacgaaacggtaacttggtacggcgttagacctacgacttcgttacgg

SEQ ID NO: 146067 - DNA, 536 bp, Homo sapiens
  misc_feature: GYAE6OF02JAW6R.21.4.A04.1.454.CMB.1.raw
  modified_base (200)..(200): a, c, t, g, unknown or other
  misc_feature (200)..(200): n is a, c, g, or t
  modified_base (357)..(357): a, c, t, g, unknown or other
  misc_feature (357)..(357): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagccagaagcctggcccaggcctcccaggttccctcatctatgcgtgggtcccacgagggccactggcatcccagacaggttcaggtgcaggtggtcnggacagacttcactctcatcatagcagactggagcctgaagatttcgcgtagttgtattactcgtcagtacagttatggtaacgttcgaccttcgttcgttcgttcggaccgtaagggaccgtaaggtaagaaacgtacggaaacgtacgtaggtacggctacgacaacctattcgtcg

SEQ ID NO: 146068 - DNA, 580 bp, Homo sapiens
  misc_feature: GYAE6OF02JS01P.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcggaccctgtctttgtctcaggggaagngccacctctcctgcagctccagccagaatatccagagctactacatagcctggtaccagcagaacgcctggccaggcctcccaggttccncatctatgctgggtaccacgngggccacgtggcatcccagacaggttcagtgcagtggtcnggacagacttcactctcatacattacgcagactaggagcctagaagtacttcgcgtagtgttattacgtgtcagtctagttacgtaggtaacttcgtaaccttcttcggttccgtttaccgggaccgtaaggggtaacccgtaaagggtaacggtaaagttaacggtaaaaccggtaacgttaggttaacgggtacgtaaccggaccgtaaccgttacgttacttacgg

SEQ ID NO: 146069 - DNA, 529 bp, Homo sapiens
  misc_feature: GYAE6OF02IW8BG.21.4.A04.1.454.CMB.1.raw
  modified_base (201)..(201): a, c, t, g, unknown or other
  misc_feature (201)..(201): n is a, c, g, or t
  modified_base (369)..(369): a, c, t, g, unknown or other
  misc_feature (369)..(369): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctccaggttcctcatctatgctgggtcccacagggccacgtggcatcccagacaggttcagtggcaggtggtctgggacagacttcactctnatcattagcagactggacgcctagaagtatttcgctagttgttacttactgtacagctaggttatggtaagttccaccgttcgtcgtcgttcggaccgtagggtacaagggtataaacgtagaaaccgacgttgtacggtctagaccaccgtatcgtacg

SEQ ID NO: 146070 - DNA, 556 bp, Homo sapiens
  misc_feature: GYAE6OF02GZOV3.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccctcatctatgctcgggtcccacgagggccacgtggcactcccagaccaggttcagtggcaggtgggtctgggacagtacttcactctcatcattagcagacgtggacgcctagaagtatttcgctagttattattactgtcagtctagttagtaggtaagttcctaccttcgtcgttcgttaccgaccgtaagggaccgtaagggtaagaaacgttaaggaaaccgtaacgtaggtacggtacgttacgacctaaccgtattcctacg

SEQ ID NO: 146071 - DNA, 504 bp, Homo sapiens
  misc_feature: GYAE6OF02IFQP8.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctagaagtatttcgctagtgttattactgtcagcagtatggtaagttcacctctgtcgttcggaccagggacctaaggtagaaagtagaaacgtactgtaggctgacactatctcg

SEQ ID NO: 146072 - DNA, 523 bp, Homo sapiens
  misc_feature: GYAE6OF02HMWN7.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctccaggttcctcatctatgctcgggtcccacgagggcccacgtggccatcccagacaggttcagtggcaggtgggtctgggacagacttcactctcatcattagcagactggagtccgtagaagtatttcgctagttgtattactgtcagctagtagtggtaagttcacttcgtgtcgttcgaccgaacgggaccgtaaggtaagaagtaggaaacgtaacgtggtacggcgtgacactatctcg

SEQ ID NO: 146073 - DNA, 702 bp, Homo sapiens
  misc_feature: GYAE6OF02IRP2P.21.4.A04.1.454.CMB.1.raw
tcagtcgtcgctcgcacgaccggtgctcgatttagagtagtgatcagggagagctgctcagttaggaccagagggaaccatggaaacccagcgcagcttctcttcctcctgctactctggctcccaggctcagaaaccaccggagaaattgtgttgacgcagtctccaggcaccctgtctttgtactccaggggaaagagccaccctctccctgcagctccagccagaatatccagagctactacatagactcgtacacgcacgaacgactacgcgaaaacggcgtcctacggttcctcgtactactactacgtctcggtcccgacgacggaccgacgtacggcgacgtaccacgaaacggttacgtacggttacggacgtacggtacgggttcgtacggggtacgtacggtaacgttaccgtaacgtacctactaacgtactaacgttacgtacgtaagtaccgtacggtacgtaccgtacgtaacggtaactttacggtacgttaacggtacgttaacgtttacgtacgttacgtacgtacgtacgtagtaggtaacgtttacgtaccgttacgttacggttacgttccgggtacgtaacgggtacccgtaaagggtaacggtaaaaggttaacggaaacggttaaacgtacggttacggtacgttacggtaccgtaaccgtacgttacgtcgtttaccg

SEQ ID NO: 146074 - DNA, 504 bp, Homo sapiens
  misc_feature: GYAE6OF02H3AP9.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccanagggccactggcatcccagacaggttcagtggcagtgggtctgggacagacttcactctcatcattagcagactggagccgtagaagtatttcgctagtgtattactgtcagtcagtatggaagttcacctntcgtcgttcggacaggaccaaggtagaaagtagaaacgaactaggtggacgtgcactatctcg

SEQ ID NO: 146075 - DNA, 500 bp, Homo sapiens
  misc_feature: GYAE6OF02HK4F1.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (439)..(439): a, c, t, g, unknown or other
  misc_feature (439)..(439): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtccccagagggccactggcatcccagacaggttcagtggcaggtgggtctgggacagacttcactctcatcatagcagacgtggagcctagaagtattcgctagtgttattactgtcagcagtagtggagttcactntgtcgttcgcgacgggacaaggtagaaagtagaaacgtactggtgctgacacctagtctcg

SEQ ID NO: 146076 - DNA, 495 bp, Homo sapiens
  misc_feature: GYAE6OF02G7KQN.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacgagggccactggcactcccagacaggttcagtggcaggtggtctgggacagacttcactctcatcattagcagactggagcctagaagtatttcgctagttgtattactgtcagcgtagtatggattcaccttctgtcgtcgctaggactaggtagaatagaacgtagtgagctgacactatctcg

SEQ ID NO: 146077 - DNA, 524 bp, Homo sapiens
  misc_feature: GYAE6OF02HA8NU.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccnatctatgctgggtcccagagggccactggcatcccagacaggttcagtgcaggtgggtctgggacagacttcactctcatcattagcagacgtggacgcctggaagatttcgctagttgtattactgtcagctagtatggtaagttcacttcgtgttccgttcggaccgtaagggaccgtaaggtaagaaagtacggaaacgtaacgtggtacggacgtgacctactactctcg

SEQ ID NO: 146078 - DNA, 607 bp, Homo sapiens
  misc_feature: GYAE6OF02H6K4K.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaacatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttccncatctatgcttgggtcccacgacgggccacgtggccactcccagacaggttcaggtcggacaggtgggtctgggacagtacttcactctcatcattacgcagacgtggacgcctagaagtatttcgctagttgttatttacgtgtacagtcctaaggttagtagggtaacgtttccaaccgtttcgttcggttccggtttaccgggacccgtaaggggtaacccgtaaaggggttaacgtaaaacggttacggaaaaaccggttaacgtagggttacgggaccgttacggtaccgtaaccgttacgttaccgttacgg

SEQ ID NO: 146079 - DNA, 503 bp, Homo sapiens
  misc_feature: GYAE6OF02H31LN.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (442)..(442): a, c, t, g, unknown or other
  misc_feature (442)..(442): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccncatctatgctgggtcccanagggccacgtggcatcccagacaggttcagtggcaggtgggtctgggacagacttcactctcatcattagcagactggagcctgaagtatttcgctagtgtattactgtcagcagttatggtaagttcacctntgtcgttcgcagggaccaaggtagaaatagaaacgtactgtacggctgacactagtctacg

SEQ ID NO: 146080 - DNA, 642 bp, Homo sapiens
  misc_feature: GYAE6OF02GGUQT.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttccncatctatgctgggtccccagagggcccacgtggccaccctccgacgacgtacgtacgaggtcgacgtagggtcggtcggtacggaacgtacgttaccttaccgtaccttcctactactacttaacgtacgacgtacgtacggtaggaccgtacgtaaggtaaacgttcgttacgacgttagttacgttaacttcgtcgtacgtacgtacgtaagttagtaaggttaccttaccttacgttcgttcggttccgggtaccggtaaccggtaaccggtaacgtaagggtaaacgtaacggtaaacggtaaacgtacgttggtacgtacgtaccgaccgtacttacgtacgttacg

SEQ ID NO: 146081 - DNA, 504 bp, Homo sapiens
  misc_feature: GYAE6OF02HEOON.21.4.A04.1.454.CMB.1.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgcctccaggggaaagagccaccctctcctgcagctccagccagaatatccagagctactacatagcctggtaccagcagaagcctggccaggctcccaggttccncatctatgctgggtcccanagggccactggcatcccagacaggttcagtggcaggtgggtctgggacagacttcactctcatcattagcagactggagcctagaagtatttcgctagttgtattactgtcagcagtatggtaagttcaccgtctgtcgttcgaccgtaggactaaggtagaagtgaaacgtactggtacggctgcactatntcg

SEQ ID NO: 146082 - DNA, 875 bp, Homo sapiens
  misc_feature: GYAE6OF02GE6X3.21.4.A04.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagagtagtgatcagggggagaggctggctccagttaggacccaggagggtaacccagtggtaaaccccagtcggcagcttctcttcctctagctactcgtggctcccaggctctaggaaaccaccggagaaatttggttcgttgacgtctagtaacgtccacggctacccttggtctttgtctaccgaggggtaaagnggccaccctcgtccgtgcctaggccttcccaacggccggactaatactccagtacgtctactacgacttacggccgttcggtaacccagacctaaggaaacgtccctaggacccaagggtccttccccggtaagggttcccctacggacttccgtaagggtcgggccttcggggggtacccctaacgggacggggtcccctaaacggtttcgggtacctaacggttccccggtaagggtaccggtaagggtttaccaaggggtttcgggtacccgtaagggtttcgggggtacctttacggggggaacctaaaggggtacccttttacgtaccgttacccttacgtaacgttaccgtaaagtttaacggacctaaacggttaccgtacgggtaacgtaacccgttaggaaacgttacgttttaccgacgttaacgttagttaacgttaacgttggtaccgtaagcgtaacggttacggtacggtaaccgtttaccgaccgtttcgttacggtttaccggttacccgggtaccgtaacgggggtaaccggtaaacggggttaacggaaacggttaacgggaaaccggtaacgttagggttacgggtaccgttacggtaccaacccggttagtcccgggttaacgg

SEQ ID NO: 146083 - DNA, 519 bp, Homo sapiens
  misc_feature: GYAE6OF02HUKXV.21.4.A04.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctntcctgcagctccagccagaatatccagagctactacatagcctggtaccagcagaagcctggccaggctcccaggttcctcatctatgctgggtcccacagggccacgtggcatcccagacaggttcagtggcagtgggtctgggacagacttcactctcatcattagcagactggagcctgaagatttcgctagtgttattactgtcagcagtagtgaagttcaccttcgtgtccgttcggccgtaagggacctaagggtaagaaagtaggaaaacgtacgtggtacggctaggaccaacctatctcgg

SEQ ID NO: 146084 - DNA, 757 bp, Homo sapiens
  misc_feature: GYAE6OF02JTGXE.21.4.A04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccacctctcctgcagctccagccagaatactccagacgctactacatagcctggtaccagcagaacgcctaggccaggcctcccgaggttccncgattcctatcgccgtcgggtcccacgacggccacgtggcctacgtacccgaaggtaccgtaggtttaccgaagggttcgggacctaggggtttcgggtacgtacgggggtaacctaacgggttacccttttaccgaaccgtttccttacgaacgttacgtaaacgtttacgaccgtaacggtaaccgttacgggtaaccgtaccgttaaggtaaacgttaccgtttcggaccgttaaggtttacgttaactttacgtcggttaccgaaggtaccgttaagttaagttacgggtaaacgtttccgtaccgtttacggttcggttaccgggttaccggaaccggtaacgggtaacccgtaaaggggttaaacggtaaaaccgttaacgggtaaaaccggttaacgtttacgggtaacgggttacgtaaccggaacctaacccgttaacgttccggtttaacg

SEQ ID NO: 146085 - DNA, 576 bp, Homo sapiens
  misc_feature: GYAE6OF02IAYJ9.21.4.A04.1.454.CMB.1.raw
  modified_base (216)..(216): a, c, t, g, unknown or other
  misc_feature (216)..(216): n is a, c, g, or t
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (479)..(479): a, c, t, g, unknown or other
  misc_feature (479)..(479): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtgggggganacttggtccagcctgggagggtccctgagactctctgtgcagcctctgcattcaccttcagtgaccacaacatggactgggtccnccaggcctcgagggagggctggagtgggtcggcgtatacgaaggaanctaacagttacagtacaagatacggcgcgtntagtagaaaggaggttcacgatcacaagagatgattacaaagtactacaactgtaactcgtagactaaagtacgaaaccagtaccctaaggaaaaaccgnggaaaccacgggccgttagtagtttagttaggtaaggtaagaacgtaaaaggtacggtagggtaagttggtagggttagggtagtccgtaggtacgg

SEQ ID NO: 146086 - DNA, 531 bp, Homo sapiens
  misc_feature: GYAE6OF02HCQAR.21.4.A04.1.454.CMB.1.raw
  modified_base (200)..(200): a, c, t, g, unknown or other
  misc_feature (200)..(200): n is a, c, g, or t
  modified_base (409)..(409): a, c, t, g, unknown or other
  misc_feature (409)..(409): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcctcatctatgctcgggtcccacgacgggccacgtggcactcccagactaggttcagtggcaggtgggtctgggacagtacttcactctcatctattagcagactggacgtcctaggaagtnttcgactagttgttattactgtcagtctagtagtaggtacgttcaccttcgtgtcgttcgaccgtagggacctaaggtagaaagtaggaaacgtacgtggtacgcgtagacctactatctcg

SEQ ID NO: 146087 - DNA, 526 bp, Homo sapiens
  misc_feature: GYAE6OF02IODYM.21.4.A04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (418)..(418): a, c, t, g, unknown or other
  misc_feature (418)..(418): n is a, c, g, or t
  modified_base (480)..(480): a, c, t, g, unknown or other
  misc_feature (480)..(480): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcaagaagcctggccaggcctcccaggttccctnatctatgctgggtccccanacgggccagtggcatcccagacaggttcagtggctaggtgggtctgggacagtacttcactctcatcattacgcagacgtggacgcttagaagtatttcgctagtnttaattactgtacagctagtataggattcactctgtccgttcgaccgaggtacaagggtaanaacgtgtaaaccgacgttggacggtctgaccaaccgtatcgttacg

SEQ ID NO: 146088 - DNA, 552 bp, Homo sapiens
  misc_feature: GYAE6OF02IMGS6.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (378)..(378): a, c, t, g, unknown or other
  misc_feature (378)..(378): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccncatctatgctgggtcccacgagggccacgtggccactcccagacaggttcagtcggacaggtgggtctgggacagtaccttcacttcncatcattagcagactggagcctagaagtatttcgctagtgtattactgtcagcagtataggtaagttcctaccgttcgtacgttcgttacggaccgtaacgggacctaaagggtaagaaacgttaggaaaaccgtaacgttagtacggtactaggacctaccgtatacgttacg

SEQ ID NO: 146089 - DNA, 498 bp, Homo sapiens
  misc_feature: GYAE6OF02HS978.21.4.A04.1.454.CMB.1.raw
  modified_base (199)..(199): a, c, t, g, unknown or other
  misc_feature (199)..(199): n is a, c, g, or t
  modified_base (468)..(468): a, c, t, g, unknown or other
  misc_feature (468)..(468): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanatccaccctctcctgcagctccagccagaatatccagagctactacatagcctggtaccagcagaagcctggccaggctcccaggttcctcatctatgctcgggtcccagagggccactggccatcccagacaggttcagtggcaggtgggtctgggacagtacttcactctcatcattagcagactggagcctagaagtatttcgctagtgttattactgtcagctagtatggaattcacctctgtcgttcgctagggaccaaggtanaatgaaacgactgtaggctgacacatctcg

SEQ ID NO: 146090 - DNA, 523 bp, Homo sapiens
  misc_feature: GYAE6OF02IEVTT.21.4.A04.1.454.CMB.1.raw
  modified_base (201)..(201): a, c, t, g, unknown or other
  misc_feature (201)..(201): n is a, c, g, or t
  modified_base (333)..(333): a, c, t, g, unknown or other
  misc_feature (333)..(333): n is a, c, g, or t
  modified_base (397)..(397): a, c, t, g, unknown or other
  misc_feature (397)..(397): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccggagctactacatagcctggtaccagcagaagcctggccaggctcccaggttcctcatctatgctgggtcccacgagggccactggcatcccagacnggttcagtgcagtgggtctgggacagacttcactctcatcatagcagactggacgcctgaagtntttcgcgtagttgtattactgtcagcagtatggtaacttcactcttggtcgttcgaccgaagggaccaaggtagaaagtacggaaacgtaacgttggtacggactagacctacgatccgtgttacc

SEQ ID NO: 146091 - DNA, 574 bp, Homo sapiens
  misc_feature: GYAE6OF02GB440.21.4.A04.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatanccagagctactacatagcctggtaccagcagaacgcctggccaggcctcccgaggttccctacactctatgctgggtcccacgacgggccacgtggccactcccgagtaccaggttcagtggcaggtgggtctgggacagcttcactctcatcattagcagacgtggagccgtagaacgtattcgactagttgttattacgtgtcgagtctagtagtaggtaagtttcaaccgttcgttcgttaccggttaccggaccgtaacggggtacctaagggttaagaaacgttacggaaaccgtaacgttggtacggtacgtacggaccaaccgtagtccgttacg

SEQ ID NO: 146092 - DNA, 513 bp, Homo sapiens
  misc_feature: GYAE6OF02H8IGL.21.4.A04.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (473)..(473): a, c, t, g, unknown or other
  misc_feature (473)..(473): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggcaggctcccaggttcctcatctatgctggtcccanagggccagtggcatcccagacaggttcagtggcaggtgggtctgggacagacttcactntcatcattagcagactggagcctagaagtatttcgctagttgtatttacngtacagtcagtntaggtaagttcacttctgtccgttcggaccgaggaccaagggtaanaaagtaggaaaccgtatggtacgcgtgaccactagtctcg

SEQ ID NO: 146093 - DNA, 553 bp, Homo sapiens
  misc_feature: GYAE6OF02G00FD.21.4.A04.1.454.CMB.1.raw
  modified_base (471)..(471): a, c, t, g, unknown or other
  misc_feature (471)..(471): n is a, c, g, or t
  modified_base (514)..(514): a, c, t, g, unknown or other
  misc_feature (514)..(514): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtagtatttacaagtgtcagtgtgaggtgcagctggtggagtcgtgggggagacttggtccagcctggagggtccctgagactctcctgtgcagcctctgcattccaccttcagtgaccacaacatggactgggtccgccaggctaccgagggaagggctgggagtgggtcggccgtaattacgaaaggaagctaacgagttacagtacagaatacggcgcgtctgtagaaaggtacgttcaccgatctacaagagatgaattacaaagactacactgtaatctagacaaatcgaacagacctagaaaaccgnggacaacggccgtagtacttagtggtaggtaacaacgaaaagnggttaggaagttggtaggtagggtacgtcgttaggtacg

SEQ ID NO: 146094 - DNA, 496 bp, Homo sapiens
  misc_feature: GYAE6OF02HPZ9J.21.4.A04.1.454.CMB.1.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
  modified_base (436)..(436): a, c, t, g, unknown or other
  misc_feature (436)..(436): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaagcctggccaggctcccaggttcctcatctatgctgggtcccanagggccactggcatcccagacaggttcagtggcagtgggtctgggacagacttcactctcatcattagcagactggagcctgaagatttcgctagtgtattactgtcagcagtatggaagttcaccttntgtcgttcgccagggacctaagggtagaatagaaacgaacgtgtaggctgacacatctcg

SEQ ID NO: 146095 - DNA, 582 bp, Homo sapiens
  misc_feature: GYAE6OF02ITNIR.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccnatctatcgctgggtccccagacgggccactggccatcccagacaggttcagtggcaggtgggtctgggacagacttcactctcgatcattacgcagactggacgtcctaggaaagtcgtttcgctacggttgttaacgtttacgtgtactagcgtaagttacgtaggtaagtttcctaaccgttcttggttccgttacggaccgtaacggggaccgtaagggtaacgtaaacgtcggtaaaaccggtacgttacggtacgggtacttacggaccgtaccgtagtccgttacgg

SEQ ID NO: 146096 - DNA, 499 bp, Homo sapiens
  misc_feature: GYAE6OF02GCH0N.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacgagggccactggcattccagacaggttcagtggcagtggtctgggacagacttcactctcatcattagcagactggagcctagaagatttcgctagtgtattactgtcagcagtatggagttccaccctgtcgttcggccgaacggaccgaaggtagaagtagaacgaactagtggctgccacatctgtc

SEQ ID NO: 146097 - DNA, 535 bp, Homo sapiens
  misc_feature: GYAE6OF02FZQOT.21.4.A04.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccangggccacgtggcatcccagacaggttcagtggcagtgggtctgggacagacttcactctcatcattagcagactggagcctagaagtatttcgctagtgttattactgtcagcagtagtaggtagttcaccttctggttccgttcggaccgtagggaccgtaagggtaacgaaagtacggaaaccgtaacgttaggtacggtactaggaccaccgtagtccgttcg

SEQ ID NO: 146098 - DNA, 566 bp, Homo sapiens
  misc_feature: GYAE6OF02H0HN8.21.4.A04.1.454.CMB.1.raw
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtcccagcccgtgggaggggtcccctggagactctcctgtgcagcctctgcattccaccttcagtgacccacaacatggacctggggtccgccaggcctccgagggagggctggagtgggcgcgtatacgaaggaagctaangttacagtacagatacggcncgtctggtagaaagggtagttcacattcacaagagatgattacaaaagtactcactgtatctagactaaatcgaacagacctaaggaaaaccgaggaccaacgggtccgtagttactttagttcggtaggtaacgaacgaaaaggtgtaggattgggtaggttaggtacggtcgttgtacgg

SEQ ID NO: 146099 - DNA, 489 bp, Homo sapiens
  misc_feature: GYAE6OF02GOS1Y.21.4.A04.1.454.CMB.1.raw
  modified_base (444)..(444): a, c, t, g, unknown or other
  misc_feature (444)..(444): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgcttcggggtccccagacgggccactggccatccccagacaggttcagtggcaggtggtctgggacagacttcactctcatcattagcagactggagcctgaagtatttcgactagtgttattactgtcagcagtatgagttcactntgtcgtcgcaggccaaggtgaatgaacgatgtgctagcacatctg

SEQ ID NO: 146100 - DNA, 609 bp, Homo sapiens
  misc_feature: GYAE6OF02I07LQ.21.4.A04.1.454.CMB.1.raw
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (459)..(459): a, c, t, g, unknown or other
  misc_feature (459)..(459): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggtttccttgttgttattttacaaggtgtccagtgtgaggtgcagctggtggagtcgtgggggagacgttggtccagcctggagggtccctgagactctcctgtgcagcctctgcattcaccttcagtgaccacaacatggactgggtccgccaggcctcgagggagggctggngtgggtcgcgtatacgaaggaanctaacngttacagtacagtaatacggcgcgtctggtagaaaggaggttcaacatctacaaagagatagattacaaagacctcaactgtactcgtagacaaaagtcgaaaccgngacccgtaagggaaaaaaccgtcgggaaaccgtaccggaccggttacgttaagttttaagtcgggttaagggttaaaccaaacgtaaaaagggcgtttaaggggtacgttacggggttagggttagggggtaactccggttaggtacggg

SEQ ID NO: 146101 - DNA, 510 bp, Homo sapiens
  misc_feature: GYAE6OF02JE2GO.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtccccagacgggcccacgtggcactcccgagacaggttcaggtgcagtcgggtctgggacagtacttcacgtctcagtcattagcagactggacgctagaagtcttcgctagtgtattatgtcagctagtatggaacttcacttgtgttcgtcgaccgaggactaaggtaacgaaatcgaaacgtagtgtaggctgacacctatctcg

SEQ ID NO: 146102 - DNA, 559 bp, Homo sapiens
  misc_feature: GYAE6OF02G0FXA.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatacgcctggtaccagcagaagcctggccaggcctcccgaggttccctcatctatcgctcgggtcccacgacgggccacgtggaccactccccgagacctaggttcaggtcggctagggtgggtctggggactagtacttcactctacatctattacgctagacgtggacgcctagaagtattcgactagtgtattacgtgtacagtactagtataggtacgttcaccgtcgtcgtcgttcggacgtacgggacctaagggtaacgtaaagtacggaaacgtacgtggtacggctacgacctacgtactcgtcg

SEQ ID NO: 146103 - DNA, 483 bp, Homo sapiens
  misc_feature: GYAE6OF02GD296.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
  modified_base (458)..(458): a, c, t, g, unknown or other
  misc_feature (458)..(458): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggctcccaggttccncatctatgctgggtcccacgagggccactggcatcccagacaggttcagtggcagtggtctgggacagacttcactctcatcattagcagactggagcctgaagtntttcgcagtgtattactgtcagcagtatggaattcacttctgtcgttcgcagggccaaggtanaatgaacgtatgtgctgcacatctg

SEQ ID NO: 146104 - DNA, 526 bp, Homo sapiens
  misc_feature: GYAE6OF02JHC3D.21.4.A04.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctccaggttcctcatctatgctgggtcccanagggccactggcatcccagaccaggttcagtggcagtggtcngggacagacttcactctnatcattagcagactggagccgtagaagatttcgctagtgtacttactgtcagctagtacgtgaagttcacttcgtagtcgtacgtaccgagggaccgtaaggtaacgaatacggaaacgacgttaggtacgggtactcggactaccgtagtcgttacgg

SEQ ID NO: 146105 - DNA, 516 bp, Homo sapiens
  misc_feature: GYAE6OF02GGX2C.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccncatctatgctgggtcccancgggccagtggcatcccagacaggttcagtggcaggtgggtctgggacagacttcactctcatcattagcagacgtggagcctagaagntttcgctagttgtattacgtgtacagtctagtataggaacgttcaccttctgtccgttcgcgacgggacctaagggtaagaagtacgaaacgtaactggtaggctagccactatctcg

SEQ ID NO: 146106 - DNA, 526 bp, Homo sapiens
  misc_feature: GYAE6OF02F4CX1.21.4.A04.1.454.CMB.1.raw
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
  modified_base (392)..(392): a, c, t, g, unknown or other
  misc_feature (392)..(392): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcaggggagaggctgctcagttagggacccagagggaaccactgggaaaccccagcgtcagcttctcttcctccgtgctactctggctcccgaggctcagaaaccaccggagaaattgtgttgacgcagtctccaggcaccctggtctttgctccaggggaaangccacctctcctgcagctccagtccagaatacnccagagctactacatagcctggtaccagaccagaagcctggccaggctcccaggttcctcatctatcgccgtgggtcccacagggcccacgtggcacgtcccagacgtaggttcaggtcggacaggttcgggtctgggacagacttcactcncatcattgcagactggagtccgtagaagtatttcgctagtgtattactgtacagtctagtagtagtaagttcaccgtctcggtcgtcgacaggacaaggtanaagtgaacgtagtgcggactgactacatctcg

SEQ ID NO: 146107 - DNA, 583 bp, Homo sapiens
  misc_feature: GYAE6OF02I1RW2.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttccncatctatgctgggtcccagagggccacgtggcatcccagacaggttcagtggcaggtggtctgggacngacttcactctcatcattagcagtactggacgccgtaggaacgtactttcgctagttattattacttgtcagtcgtaagttagtaggtaacgttccacctttcgtcggtttccgttccgggacccgtaacggggtaccgtaaagggttaacggtaaaacgtacggtaaaaccggtaacgttagggtacggtacgttccggaacctaaccgttacgttacgttacg

SEQ ID NO: 146108 - DNA, 532 bp, Homo sapiens
  misc_feature: GYAE6OF02GEGJU.21.4.A04.1.454.CMB.1.raw
  modified_base (201)..(201): a, c, t, g, unknown or other
  misc_feature (201)..(201): n is a, c, g, or t
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccgaggttcctcatctatgctgggtcccagacgggccacgtggcactcccagacaggttcaggtggcaggtggtctgggacagtacttcactctcatcatagcagtactggacgtcctagaagtatttcgctagttnttattactgtacagctagtagtaggtaagttcaccttntcgtccgttcggaccgtagggacctaaggtaagaaacgtacgtaaacgtacgtgtcggactgacctacgtatcgtcg

SEQ ID NO: 146109 - DNA, 568 bp, Homo sapiens
  misc_feature: GYAE6OF02H03PQ.21.4.A04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgctccaggggaaanagccaccctntcctgcagctccagccagaatatccagagctactacatagcctggtaccagcagaagcctggccaggcctccaggttccncatctatgctgggtcccacgagggccacgtggcatcccagacaggttcagtggcaggtcgggtctgggacagacttcactctcatcattagcagacgtggacgcctagaagtatttcgctagttgttattacgtgtacagtactagttagtaggtaacgttcgaccttcgtggttaccgttaccggaccgtaacggggtacctaaaggggtaacgtaaagtacggaaaaccgtaacgttaggtacggacgtacggaccgtaacctacgttcgttacgg

SEQ ID NO: 146110 - DNA, 701 bp, Homo sapiens
  misc_feature: GYAE6OF02J1GX7.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatactccagagctactacatagcctggtaccagcagagcctggccaggcctcccaggttcctcatctatgcgtcgggtccccacgacgggccacgtggccacgtaccccagaccaggtttccagttcggaccgaggtgggttcctagggaacctaggtacctttcgaccttcgtacctaagttcctaatttacggaccaacggtaccgttagggaccgtcccgttaggaaacgttcgtttaccggacttaacggttcgtttaactttacgtcggttaccaaggtaccgtaaggttacgttaacgggtaaacgtttaccctaaccgttaccggtttcggttccggtttacccggggaacccgtaacgggggtaaccctaaaaggggttaacgtaaaacggttacggtaaaaaccggtaccgtttagggtacgggttaccgtacggacccgtaaaccgtacgttcggttaccgg

SEQ ID NO: 146111 - DNA, 594 bp, Homo sapiens
  misc_feature: GYAE6OF02IZIA7.21.4.A04.1.454.CMB.1.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatactccagagctaactacatacgcctggtaccagcagaacgcctggcccaggcctcccgaggttcctcatctatgccgtcgggtcccacgacgggccacgtggcactcccagaccaggttcaggtgcaggtgggtctgggacngacttcactctcatcattagacagacgtggacgtcgtagaacgtatttcgactagttgttattacgtgtacagtctaaggttagtaggtaaacttccaccgttcgttcggttccgttaccgggaccgtaacggggtaacccgtaaaggggtaacgtaaaacgtacggtaaaaccgtacgttaggtacggtacgttacggaccaaccgttagtccgttacg

SEQ ID NO: 146112 - DNA, 598 bp, Homo sapiens
  misc_feature: GYAE6OF02IS46N.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatagcctggtaccagcagaagcctggccaggcctcccgaggttccctcattctatgccgtcgggtccccacgacgggccacgtggccactcccgaagaccgtaggttcagtggactaggtcgggtctgggacagtacttcactctcatactattacgacgagacgtggacgccgtaggtaacgtagtttcggactagttcgttaattacgtgtcagtcgtaagtagtaggtaacgttcctaccgttcgttcgtaccggttccggaccgtaagggaaccgtaagggtaacggaaacgtaacggaaacgtaacggtggtacggtacgtacggacctaaccgtacgtcgttacg

SEQ ID NO: 146113 - DNA, 491 bp, Homo sapiens
  misc_feature: GYAE6OF02H4A65.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatatccagagctactacatagcctggtaccagcagaagcctggccaggctcccaggttcctcatctatgctgggtcccacgagggccactggcatcccagacaggttcagtgcaggtgggtctgggacagacttcactctacatcattagcagactggacgctgaagtatttcgctagttgtattactgtcagctagtatgtaagttcactctgtcgttcgcaggaccaaggtagaatagaacgactgtgctgcactatctcg

SEQ ID NO: 146114 - DNA, 509 bp, Homo sapiens
  misc_feature: GYAE6OF02GNNWI.21.4.A04.1.454.CMB.1.raw
  modified_base (200)..(200): a, c, t, g, unknown or other
  misc_feature (200)..(200): n is a, c, g, or t
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggacgcctagaagtntttcgactagttagtattactgtcagcaagttatggtaagttcaccttctgtcgttcggccagggaccaaggtacgaataggaaacgacgtgtacggctgacactatctcg

SEQ ID NO: 146115 - DNA, 587 bp, Homo sapiens
  misc_feature: GYAE6OF02GZDH7.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccacctctcctgcagctccagccagaatactccagagctaactacatagcctggtaccagcagaagcctggccaggctcccaggttcctcatctatgcgtgggtcccacgagggccactggccactcccagacaggttcaggtggcaggtgggtctggggacagtacttcactctacatcattagcagtactggacgcctagaagtctttacgctaggttgttaacttacgtcgtacagtcctaaggttagtagggtaactttctaccgttcgttagttccggttaccggaaccgtaacggggtaaccctaaagggttaacgtaaacgtaacggtaaaacgtaacgttaggtacggtcttacggacctaacgtacgttcgttacg

SEQ ID NO: 146116 - DNA, 533 bp, Homo sapiens
  misc_feature: GYAE6OF02GLPEC.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctcgggtccccagacgggcccacgtggcatcccagacaggttcagtggcaggtgggtctgggacagtacttcactctcatcattagcagacgtggagcctaggaagtactttcgactagttgttattacgtgtcgagtcagttagtaggtaattcaccttctcgtcgttcggacagggaccaaggtaagaagtacggaaacgtacgtggtacggactcgaccacctagtcttacg

SEQ ID NO: 146117 - DNA, 589 bp, Homo sapiens
  misc_feature: GYAE6OF02GQE57.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctctcctgcagctccagccagaatatccagagctactacatacgcctggtaccagcagaagcctggccaggctcccaggttccnatctatcgctcgggtcccagacgggccacgtggcactcccagactaggttcagtggcaggtcggtctgggacagtacttcgactctcatcattacgctagactggacgtcgtagaagtacgtttcgactaggttgtattacgtgtcgagtctaagttacgtagggtaacgtttccaaccgtttcgtacggttaccggttccggaccgtaacggggtaccgtaaagggttaaggtaaacgttacggaaaaccgttaacgtacggtacggtaccgtaggaacctaaccgttacgtccgttacg

SEQ ID NO: 146118 - DNA, 489 bp, Homo sapiens
  misc_feature: GYAE6OF02FOGMJ.21.4.A04.1.454.CMB.1.raw
  modified_base (200)..(200): a, c, t, g, unknown or other
  misc_feature (200)..(200): n is a, c, g, or t
  modified_base (486)..(486): a, c, t, g, unknown or other
  misc_feature (486)..(486): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagcttcactctcatcattagcagactggagcctgaagtatttcgcagttgtattactgtcagcagtatggaagttcactctgtcgttcgccagggaccaaggtagaatgaaacgtatggtgctgacacatntcg

SEQ ID NO: 146119 - DNA, 550 bp, Homo sapiens
  misc_feature: GYAE6OF02HTLJU.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctccaggttcctcatctatgctgggtcccanagggccacgtggcactcccagacaggttcagtggcaggtggtctgggacagacttcactctcatcattagcagactggacgtcctagaagtatttacgactagttagttatttactgtacagtctaagttagtaggtaagttccaccttcgtgttccggtttacggacccgtaagggaccgtaaagggtaagaaacgtaggaaaccgtaacgtagtacggactaggaccacgtactcgtacg

SEQ ID NO: 146120 - DNA, 541 bp, Homo sapiens
  misc_feature: GYAE6OF02I9EIZ.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccagagggccacgtggcatcccagaccaggttcagtggcaggtgggtctgggacagacttcactctcatcattagcagactggagcctagaagtatttcgactagtgttattacgtgtcagcagtagtaggtaattccgaccttcgtcgttcgttaccggaccgtaacgggacgtaagggtaagtaaacgtacggaaacgtaacgtggtaggtcgtaggaccaactacgtcttacg

SEQ ID NO: 146121 - DNA, 621 bp, Homo sapiens
  misc_feature: GYAE6OF02G52L3.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccnatctatgctgggtcccacgngggccatggcatcccagcaggtcagtgcagtggcngggacagacttnactctcatcattagcagacgtggacgtccgtagaagtacgtttcgacgtaggttacgttaactttaacgttcggtactaaggtaccgtaaggtttacgtacgggttaaacgtttccgtaacccgtttccgttacggtttaccgggtttaccgggtacccgtaaacgggggtaacccgtaaaggggttaaacggaaaacggttaaggaaaacccggtaacgttagggtacggtaccgttaggaccctaaccgtacttccgttacg

SEQ ID NO: 146122 - DNA, 486 bp, Homo sapiens
  misc_feature: GYAE6OF02GOJ0A.21.4.A04.1.454.CMB.1.raw
  modified_base (200)..(200): a, c, t, g, unknown or other
  misc_feature (200)..(200): n is a, c, g, or t
  modified_base (458)..(458): a, c, t, g, unknown or other
  misc_feature (458)..(458): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacagggccactggcatcccagacaggttcagtgcagtgggtctgggacagacttcactctcatcattagcagactggagcctgaagatttcgctagtgtattactgtcagcagtatggagttcactctgtcgtcgccagggaccaaggtanaatgaaacgactgtagctgcacatctcg

SEQ ID NO: 146123 - DNA, 538 bp, Homo sapiens
  misc_feature: GYAE6OF02IWJ3Y.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttccncatctatgctgggtccccagacgggccactggcatcccgagacaggttcagtggcaggtgggtctggggacagaccttcactctcaccatcagcaggactggacgccgtagaagtatttcgactaattgttaacttacgtgtacagtactaatagtcgcctacccgaccccgtactacctaccgtacgaccgacggacacggactcgacaagactacgaaccgtacgtggtcgcgtacgacctaaccg

SEQ ID NO: 146124 - DNA, 522 bp, Homo sapiens
  misc_feature: GYAE6OF02FXPIV.21.4.A04.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctcccaggttccctcatctatgctgggtcccagagggccactggcatcccagacaggttcagtggcagtggtctgggacagacttcactctnatcattagcagactggacgctagaagtactttcgctagttgttattacgtgtacagctagtagtggtaagttcaccttntcgttcgttcggaccgtagggaccaaggtaagaaagtagaaacgtaacgtagtaggctacgacaccgtatcgtacg

SEQ ID NO: 146125 - DNA, 511 bp, Homo sapiens
  misc_feature: GYAE6OF02GXQF5.21.4.A04.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccanacgggccacgtggcatcccagacaggttcagtggcaggtggtctgggacagtacttcactctcatcattagcagactggagtcctagaagtntttcgctagttgttattactgtcagtctagtatggtaagttcaccttgtgtcgttcggacagggaccaaggtagaatagaaacgtacgtagtcggctgacacgatcgtcg

SEQ ID NO: 146126 - DNA, 500 bp, Homo sapiens
  misc_feature: GYAE6OF02HMVQI.21.4.A04.1.454.CMB.1.raw
  modified_base (200)..(200): a, c, t, g, unknown or other
  misc_feature (200)..(200): n is a, c, g, or t
  modified_base (372)..(372): a, c, t, g, unknown or other
  misc_feature (372)..(372): n is a, c, g, or t
  modified_base (469)..(469): a, c, t, g, unknown or other
  misc_feature (469)..(469): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtccccacgagggccactggcactcccagacaggttcagtggcaggtgggtctgggacagacttcactctnatcattagcagactggagtcctgaagtatttcgctagttgtattactgtcagcagttatggaagttcaccttctgtcgttcggcagggacaaggtanaatgaaacgtacgtgtggctgcacctatctg

SEQ ID NO: 146127 - DNA, 525 bp, Homo sapiens
  misc_feature: GYAE6OF02G2EFQ.21.4.A04.1.454.CMB.1.raw
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggaggggctgggagtgggtcggccgtatacgaaggaaagctaaacagttacagtacagaatacgggcgcgtctgtagaaagggtaaggttccaccatactacaagagatgaattacaaagactcactgtatctgacaaatgaacagacctagaaaccgaggacacggctgtatntggtgtanacaaagngtagatggtgtggtagtctgtcg

SEQ ID NO: 146128 - DNA, 507 bp, Homo sapiens
  misc_feature: GYAE6OF02J03PN.21.4.A04.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctntcctgcagctccagccagaatatccagagctactacatagcctggtaccagcagaagcctggccaggctcccaggttcctnatctatgctgggtcccagacgggccactggcatcccagacaggttcagtggcaggtgggtctgggacagacttcactctcatcatagcagacgtggacgctagaacgtatttcgctagttgtattactgtcagcagtataggtattcactctcgtcgttcgaccgtaggacaaggtacgaagtacgaaacgtacgtggacggtctacgcactatctcg

SEQ ID NO: 146129 - DNA, 539 bp, Homo sapiens
  misc_feature: GYAE6OF02H53D1.21.4.A04.1.454.CMB.1.raw
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
  modified_base (513)..(513): a, c, t, g, unknown or other
  misc_feature (513)..(513): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcacctttcagtgaccacaacatggactggggtccgccaggctccaggggaaggggctgggagtggggtcggccgtatacgaaggaaagctaacagttacagtacaagaatacggcgcgtctgtagaaaggaggttacaccatctacaaagagatgattacaaaagaacctcactgtatctagcaaatgaacagccctaggaaaaccgnggacaacggcgtagtattnttggtgtaagacaaaaggngtggtatggtaggtggtagctgtacg

SEQ ID NO: 146130 - DNA, 635 bp, Homo sapiens
  misc_feature: GYAE6OF02JVQ8A.21.4.A04.1.454.CMB.1.raw
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (543)..(543): a, c, t, g, unknown or other
  misc_feature (543)..(543): n is a, c, g, or t
  modified_base (628)..(628): a, c, t, g, unknown or other
  misc_feature (628)..(628): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttcgtgtaggtacttacaagtgtcagtgtgagtgcagctggtggagtcgtgggggagacttgggtccagccgtgggagggtccctggacgactctcctgtcgcagcctctgcattcaccttgagtcaccacacagtggactgggtccnccaggctcgagggagggctggaggtcgggtcggacgtagttacgaaagggaacnctaacgagttaccagttacaaggtaaactacgggcgtacgtcgtaggtaggaaacgggtaggtttacccacctagtcctaacgaaacggagaattcgggaattaaccgaaaaggttacccttacaaccgttgttaaagtccgttacggaactaaaggtgaacccgtaagcccgtaacggaaaaaccgngggacccaacggggtctaaggttacttacggttggaggttaacgaacaaaaggtggtacggaattggtaagggttgaacggttgnttacggg

SEQ ID NO: 146131 - DNA, 519 bp, Homo sapiens
  misc_feature: GYAE6OF02IQKN6.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
  modified_base (387)..(387): a, c, t, g, unknown or other
  misc_feature (387)..(387): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgctccgaggggaaanagccacctntcctgcagctccagccagaatatccagagctactacatagcctggtaccagcagaagcctggccaggctcccaggttccncatctatgctgggtcccagagggccactggcactcccagactaggttcagtggcagtggtctgggacagtacttcactctcatcattagcagactggancctgaatattcgcagtgtattactgtcagcagtagtaggagttcacgtctagtccgttacgccgtaagggacctaagggtaagaaacttggaaaacgtactggttacggactacgactaccctagtcttacg

SEQ ID NO: 146132 - DNA, 506 bp, Homo sapiens
  misc_feature: GYAE6OF02HWEZ0.21.4.A04.1.454.CMB.1.raw
  modified_base (200)..(200): a, c, t, g, unknown or other
  misc_feature (200)..(200): n is a, c, g, or t
  modified_base (468)..(468): a, c, t, g, unknown or other
  misc_feature (468)..(468): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtggtctggggacagacttcactctcatcattagcagactggagcctgaagtatttcgctagttgtattactgtcagcagtatggaattcaccttctgtcgttcgccgaagggtaccaagggtaanaaagtagaaacgtacgtgtaggctagaccactatctcg

SEQ ID NO: 146133 - DNA, 572 bp, Homo sapiens
  misc_feature: GYAE6OF02GF5O1.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacgacgggccacgtggcatcccagacaggttcagtgcagtggtctgggacagcttcactctcatcattagcagacgtggacgcctagaagtagtttcgacgtagttgtaattacgtgtacagtactagtagtaggtaacgttctaccttcgttcgttacgttccggtaccgtaacgggaaccgtaaagggtaacggtaaacgttaacggtaaaaccgtaacgttaggtacgggtacgttacggacctaaccgtacgtcgttacgg

SEQ ID NO: 146134 - DNA, 633 bp, Homo sapiens
  misc_feature: GYAE6OF02FGDIM.21.4.A04.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanctccacctctcctgcagcctccagccagaatactccagagctactacatagcctggtaccagcagaacgcctggccaggcctcccgagttccctnatctatgctcgggtcccagacgggccacgtggcctacgtcccaaggaccaggttcaggtcggcctagggtcgggtactggggacagtaccttcgactctcactcatagcagacgtggacgtcctagaacgtactttcgactagttagttacttacgttcgtaccgaggtctaaggttaacgtacgggtaaacgtttacctaaccgttccgttacggttaccggtttaccggacccggtaacgggaaccgtaagggttaaacgtaaacgtaacggtaaaaccggtaacgttacggtacgggtaccgtaccggacctaacccgtacgttaccgttaccgg

SEQ ID NO: 146135 - DNA, 508 bp, Homo sapiens
  misc_feature: GYAE6OF02GNA79.21.4.A04.1.454.CMB.1.raw
  modified_base (200)..(200): a, c, t, g, unknown or other
  misc_feature (200)..(200): n is a, c, g, or t
  modified_base (400)..(400): a, c, t, g, unknown or other
  misc_feature (400)..(400): n is a, c, g, or t
  modified_base (439)..(439): a, c, t, g, unknown or other
  misc_feature (439)..(439): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccagagggccactggcatcccagacaggttcagtgcagtggtctgggacagacttcactctacatcattagcagactggagcctgaagtattcgntagtgtattactgtcagcagtataggtagttcaccgttntgttcgtcggaccagggaccaaggtagaaagtcgaaacgtacgttgtacggcgtagccacctatctacg

SEQ ID NO: 146136 - DNA, 620 bp, Homo sapiens
  misc_feature: GYAE6OF02I6PMA.21.4.A04.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (377)..(377): a, c, t, g, unknown or other
  misc_feature (377)..(377): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttctgtagtatttacaaggtgtcagtgtgaggtgcagctggtggagtctgggggagacttggtccagcctgggaggtccctgagactctccngtgcagcctctgcattcaccttcagtgaccacaacntggtactgggtccnccgaggcctccgagggtaagggctgggagtcgggtcggccgtatacgaaggaagctaacagttacagtacgagaactacggcncgtactggtacgaaaggtaaggttaccaacccgattcctcgaaacgagtaacgtagtaacttaaccgaaaaggtacttaccgaaccgttgtaaacttcgtgaacctaaagttacgaaacgtacgtacccgtacggaaaaaccggacggacccgaacgggtaccgtagttacgttagttacggtaggtaacgtaagaaaacggtgtaggtaagttgggtacgtagggttaacgcgtagtaacgg

SEQ ID NO: 146137 - DNA, 555 bp, Homo sapiens
  misc_feature: GYAE6OF02JJM7Z.21.4.A04.1.454.CMB.1.raw
  modified_base (200)..(200): a, c, t, g, unknown or other
  misc_feature (200)..(200): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagacgctactacatagcctggtaccagcagaagcctggccaggcctcccgaggttccctcattcctatcgccttcgggtaccccacgacgggcccaacgtcggaccaactccccgaaggacctacgggtttcaaggttcggccaaggttcggggtctggggacagtaccttcgacttctcatcatagcagactgganccgtagaagtntttcgactagttgtattactgtcagctagtagtagaacgttcacttgtcgtcgttacgacgtaggacgtaaggtagaatcgaaacgacgtgtacgcgtcgacacgtatcgtcg

SEQ ID NO: 146138 - DNA, 561 bp, Homo sapiens
  misc_feature: GYAE6OF02I9EJM.21.4.A04.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaangccaccctctcctgcagctccagccaagaactatccagagctacacatagcctggtaccagcagaagcctggccaggcctcccgaggtttccnatctatgctcgggtcccacgagggccacgtggcactcccagacnggttcagtgcaggtggtctgggacagtcttcgacttctcatctattagctagacgtaggacgtcgtagaagtatttcgactagtgttattactgtcagtctagtagtggtaagttctaccgttcgtggtccgttacggaccgtaagggtacctaagggtaacgtaaacgttaacggaaacggtaaccgttaggtacggcgttacgaccgtaactacgttcttacgg

SEQ ID NO: 146139 - DNA, 505 bp, Homo sapiens
  misc_feature: GYAE6OF02FTV6J.21.4.A04.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatccaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccanagggccactggcatcccagacaggttcagtggcaggtggtctgggacagacttcactctacatcatagcagactggacgccgtagaagatttcgctagttgtattactgtcagcagtagtggtaagttcacttctgtcgttcggccagggaccaaggtaagaaatagaaacgtaactgtagctgacacctatctcg

SEQ ID NO: 146140 - DNA, 523 bp, Homo sapiens
  misc_feature: GYAE6OF02GLXSV.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctctcctgcagctccagccagaatatccagagctactacatagcctggtaccagcagaagcctggccaggctcccaggttcctcatctatcgctcgggtcccagacgggccacgtggcactcccagacaggttcagtgcagtggtctgggacagacttcactctcatcattagcagactggacgccgtagaagtatttcgactagtgttattacgtgtacagtcagtagtagtagttcactctcgtcgttcgaccgtaggaccgaaggtaagaaacgtacgaaacgtaacgtggtacggactgacaccgtagtcgtacg

SEQ ID NO: 146141 - DNA, 486 bp, Homo sapiens
  misc_feature: GYAE6OF02JFS73.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (437)..(437): a, c, t, g, unknown or other
  misc_feature (437)..(437): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccacgagggccactggcatcccagacaggttcagtggcaggtggtctgggacagacttcactctcatcattagcagactggacgcctgaagtatttcgctagttgtattactgtcagcagtatggattcactntgtcgttcgcaggacaggtagaatagaacgacgtgtagctgcacatctg

SEQ ID NO: 146142 - DNA, 488 bp, Homo sapiens
  misc_feature: GYAE6OF02FQXYC.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcccnatctatgctgggtcccacngggccactggcatcccagacaggttcagtgcagtgggtctgggacagacttcactctcatcattagcagactggancctgaagnttcgcagtgtattactgtcagcagtatggtaatcactctgtcgttcgccaggaccaaggtanaatagaaacgaactgtggctagcacctatctcg

SEQ ID NO: 146143 - DNA, 583 bp, Homo sapiens
  misc_feature: GYAE6OF02J069O.21.4.A04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcaagaacgcctggccaggcctcccaggttcccncatctatcgcgtgggtcccacgacgggccacgtggcactcccagacaggttcagtggcaggtgggtctgggacagacttcactctcatcagttagcagtactggacgtccgtagaagtctttcggacgtagttcgttattacgtgtcgaagtcgtagtatagggtaacttccgaccttgtacggttcgttaccgggaccgtaacgggtaccgtaaaggttaacggtaaacgtacggtaaaaccgtaacgttcggtacggtaccgtacggacctaacgtagttccgttacg

SEQ ID NO: 146144 - DNA, 624 bp, Homo sapiens
  misc_feature: GYAE6OF02JMSSO.21.4.A04.1.454.CMB.1.raw
  modified_base (199)..(199): a, c, t, g, unknown or other
  misc_feature (199)..(199): n is a, c, g, or t
  modified_base (284)..(284): a, c, t, g, unknown or other
  misc_feature (284)..(284): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagagcctggcagctccaggttccncatctatcgcgtcggtaccacgacggcctacgtggccactcccgaagaccgtaggttaccaggtcggactagggtcggtcgtagggacagtaccttcaccgttctacacgttactagttacgccgtaggtaccgtgggacaccgttagaacgttcgttcgacgtagttagttacgttacgtgtaccaggtcctaaggttagtacggtacgttaccaccgtttgtcggttaccgttaccgggaaccgtaagggtaacccgtaagggtaaacgtaaacgtacggtaaaacggtaccgttagggtaccggtacgttacgaccgttaaccgtacttcgttacgg

SEQ ID NO: 146145 - DNA, 532 bp, Homo sapiens
  misc_feature: GYAE6OF02GU4H1.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacgagggccactggcactcccagacaggttcagtggcaggtggtctgggacagacttcactctcatcattagcagtactgggacgcctagaagtactttcggactagttgtattacgtgtacagtcgagttagtggtaacttcaccttcgtgtccgttcggccgaagggaccgaaggtaagaaagttaggaaacgtaacgtggtagcgtgaccaccgtatccgtcg

SEQ ID NO: 146146 - DNA, 573 bp, Homo sapiens
  misc_feature: GYAE6OF02IHW5K.21.4.A04.1.454.CMB.1.raw
  modified_base (216)..(216): a, c, t, g, unknown or other
  misc_feature (216)..(216): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggttgtccagtgtgaggtgcagctggtggagtctggggganacttggtccagcctggagggtccctgagactctcctgtgcagcctctgcattcaccttcagtgaccacaacatggacttggggtccgccaggctccgagggaagggctggagtgggtcggcgtatacgaaggaagctaacagttacagtacagaatacggcncgtntagtgaaaggaggttcaccatactacgaagagatagattacaaagtaactcacttgtatctagacaaatagaacagacctaaggaaaaccgaggaacgacggaccgttgtattagttacggtaggtaacgaacgtaaaaggtaggtagggtagttagggttagggttagggttaagtccgttaggtaccgg

SEQ ID NO: 146147 - DNA, 497 bp, Homo sapiens
  misc_feature: GYAE6OF02GL667.21.4.A04.1.454.CMB.1.raw
  modified_base (200)..(200): a, c, t, g, unknown or other
  misc_feature (200)..(200): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgttttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctagaagtatttcgctagtgttattactgtcagctagtatggaagttcacctntgtcgtcgccaaggacaaggtagaaatgaaacgacgtgtaggctagcacatctgtc

SEQ ID NO: 146148 - DNA, 591 bp, Homo sapiens
  misc_feature: GYAE6OF02IBRLY.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntccngcagctccagccagaatatccagagctactacatacgcctggtaccagcagaagcctggccaggcctcccaggttccncatctatgctcgggtcccagacgggccacgtggccaactccccgaagactaggttccaggtcggctaggtgggtcnggggacagtacttcactctacatcattacgacagactggacgccgtagaagtatttcgacgtagtgttatttacgtgtacagtctaaggttataggtaagttccgtaccgttcgtcggttccggttacgggaccgtaacgggtaacccgtaagggtaacgtaaacgttacggaaaccggtaacgttaggtacggacgttacggacctaaccgtacgtcgttacgg

SEQ ID NO: 146149 - DNA, 528 bp, Homo sapiens
  misc_feature: GYAE6OF02I3FMP.21.4.A04.1.454.CMB.1.raw
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
  modified_base (414)..(414): a, c, t, g, unknown or other
  misc_feature (414)..(414): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaacgcctggcccaggctcccaggttccncatctatcgctcgggtcccacgacgggccacgtggcatcccgagacaggttcagtggcagtgggtctgggaacngtacttcactctcatcattagcagactggatccgtagaagtatttcgntagtagttattactgtcagctagtatggtaacttcacttgtgttcgttcgaccgaggtacgaaggtagaaagtaggaaacgtaacgtgtcggactacggactaccgtatctacg

SEQ ID NO: 146150 - DNA, 513 bp, Homo sapiens
  misc_feature: GYAE6OF02HKHBQ.21.4.A04.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccagngggccacgtggcatcccagacaggttcagtgcagtggctgggacngacttcactctcatcattagcagacgtggacgtctagaagtagtttcgactagttagttattactgtcagctagtagtagtaagttcaccttgtgtcgttcggaccgaagggacctaaggtaacgaagtacgaaacgagtggtagctagacactatctg

SEQ ID NO: 146151 - DNA, 564 bp, Homo sapiens
  misc_feature: GYAE6OF02HXC4L.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacatggactgggtccgcaggctccgagggagggctggagtgggtcggccgtatacgaaggaagctaacagttacagtacaagaactacggcgcgtctgtagaaaggtagttccaactatactacaaagagatagattacgaaaagactacaacttgtaactctagacaaagtagaaacagacctaagaaaaccgaggaacgaccggcgtagttattagttaggtaggtaagaacgaaaaggtggtaggagttggtagggtagggtaatcgtagtacgg

SEQ ID NO: 146152 - DNA, 503 bp, Homo sapiens
  misc_feature: GYAE6OF02GXUUF.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
  modified_base (442)..(442): a, c, t, g, unknown or other
  misc_feature (442)..(442): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccagagggccactggcatcccagacaggttcagtggcaggtgggtctgggacagacttcactctcatcattagcagactggacgcctagaagtntttcgctagttgttattactgtcagtcagtatggtaattcactntgtcgtcgacagggacctaaggtagaataggaaacgtacgtggtcggctgacactatctcg

SEQ ID NO: 146153 - DNA, 559 bp, Homo sapiens
  misc_feature: GYAE6OF02JE9QQ.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (430)..(430): a, c, t, g, unknown or other
  misc_feature (430)..(430): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccagacgggccactggcacgtcccaagacaggttcagtcggctaggtggtctgggacagtacttcactctacatctattagcagacgtggacgtctagaagtacgtttcgctagtgttattacgtntcagtcagttagtagtaacgttcctaccgttgtcgttcgttaccggaccgtacgggaaccgtaaggtaacggtaaagtacggaaacgtaacgttaggtacggtactacgaccaaccgtacgtcttacgg

SEQ ID NO: 146154 - DNA, 665 bp, Homo sapiens
  misc_feature: GYAE6OF02I6DOI.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccacctctcctgcagctccagccagaatactccagacgctaactacatacgcctggtaccagcagaacgcctggccaggcctacccgaggttcctacatctagtcgcgtcggtacccacgacgggccacgtggacctactacccgagtaccacggtttccaaggttcggaccgtagggtcgggtcgtaggggacctaggtacctttcgaacgttcctacgtacttacctaagttacgacgtaacgtacgtacggtacgtaccgtaggtaaacgtacgtttcggacgttaaggttacgttacgttacgttgtacgacgtacgtaaggttagtacgggtaacttccgaaccgtttcgtcgttaccggttacggaaccgtaacgggtaaccgtaagggtaacgtaaacgttacggaaacgtaacgtcgggtacgtactaccggtactacccgtagtccttaccgg

SEQ ID NO: 146155 - DNA, 507 bp, Homo sapiens
  misc_feature: GYAE6OF02JEZ7Y.21.4.A04.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtagtgatcaggggagagctgctcagttaggacccagagggaaccatgggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctcccaggttcctcatctatgctcgggtcccanagggccactggcaactcccagacaggttcagtggcaggtgggtctgggacagcttcacttcncatcattagcagactggagctgaagatttcgcagttntattactgtcagcagtatggaagttcaccttcgtgttacgttcggaccgtacggacgaaggtaagaaataggaaacgagtagtgcgtgacacagtntcg

SEQ ID NO: 146156 - DNA, 849 bp, Homo sapiens
  misc_feature: GYAE6OF02JC46B.21.4.A04.1.454.CMB.1.raw
  modified_base (203)..(203): a, c, t, g, unknown or other
  misc_feature (203)..(203): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtcctccgaggggaaangcccacccttctcctgccagcctccagccaagaactactccaagacgccttaactacattacggccttaggtaaccaggccaaggaacgcctggccaggcctcccaggttccctacactctagtcgccgtcgggtcccacgacgggcccagtcgcacgtcccgagtacnggttcaggtcggacctagggtttgggtcgtaggggacctaggtactttccgaacttctacatacagttacgcgtaagtaccgtaggaccgtaccgtaggtaaacgtacgtttccggaacgtttaggtttacgtaacgttttacgttacggtaaccgtaacggtaccgttaaacggtttaacggttacgggtttaaaacggttttaccccgttaacccggtttaacggttttacccggggttaacccgggtttttacccggggaaaccccgggtttaaaaccgggggggttaaaacccccggttaaaaaccgggggtttaaaaacggggtttaaaaaaaccccggtttaaccgggggttaaaaaaaaccccggggttaaccggttttaaaccgggggttaaccgggtaaccccggttttaacgggtaaacccccgttaaacccgggtttaaccggtttacccgtttttaaccccgggg

SEQ ID NO: 146157 - DNA, 494 bp, Homo sapiens
  misc_feature: GYAE6OF02FQ17K.21.4.A04.1.454.CMB.1.raw
  modified_base (200)..(200): a, c, t, g, unknown or other
  misc_feature (200)..(200): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacgagggccacgtggcactcccagacaggttcagtggcagtgggtctgggacagacttcactctcatcattagcagactggacgcctgaagtntttcgctagtnttattactgtcagcagtagtggtattcactntgtcgtcgccaggactaaggtagaatgaaacgtactgtggctgcactatctcg

SEQ ID NO: 146158 - DNA, 573 bp, Homo sapiens
  misc_feature: GYAE6OF02HNL58.21.4.A04.1.454.CMB.1.raw
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (414)..(414): a, c, t, g, unknown or other
  misc_feature (414)..(414): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaancctggccaggcctcccaggttccctcatctatgctcgggtcccagagggccacgtggcactccagactaggttcagtggcagtgggctgggacagtacttcactctcatcattagcagactaggagtcctagaagtatttcgatagtnttaattactggtacagtctagttagtaggtaagttccaacttccgttgttaccggttccgggaaccgtaacggggtaacccgtaaagggtaagaaacgttacggaaaaccgtaacgttacggtacggaccttaggaccctaaccgtacttcgttaccgg

SEQ ID NO: 146159 - DNA, 520 bp, Homo sapiens
  misc_feature: GYAE6OF02GEBCN.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatcgctcgggtccccacgacgggccacgtggcactcccagacaggttcagtggcaggtgggtctgggacagacttcactctcatcattagcagacgtggacgccgtagaagtatttcggactagttgttattactgtcagtcagttatggtaacgttcacctcgtgtcgttcgaccgaggacgtaaggtaagaatagaaacgacgtagtcgctgacactatcgtcg

SEQ ID NO: 146160 - DNA, 575 bp, Homo sapiens
  misc_feature: GYAE6OF02GQLUA.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctctcctgcagctccagccagaatatccagagctactacatagcctggtaccagcaagaacgcctggccaggcctcccgaggttccctcatctatcgctcgggtacccacgagggccacgtggccactcccagacaggttcagtggctaggtggtctgggacagtactcactctctatcattacgcagtacgtggacgcgtagaagtacgttcgacgtagttagttacttacgtgtacgagtacgtagttagtaggtaagttctaccgttctcgttcgttacgtaccgacgggtaaccgtaaggtaacggaaacgtaacggtaaacggtacgtaggtacggtactacgaccgtacctagtacgttacg

SEQ ID NO: 146161 - DNA, 586 bp, Homo sapiens
  misc_feature: GYAE6OF02H2BDH.21.4.A04.1.454.CMB.1.raw
  modified_base (199)..(199): a, c, t, g, unknown or other
  misc_feature (199)..(199): n is a, c, g, or t
  modified_base (389)..(389): a, c, t, g, unknown or other
  misc_feature (389)..(389): n is a, c, g, or t
  modified_base (428)..(428): a, c, t, g, unknown or other
  misc_feature (428)..(428): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacgagggccactggcatcccagacaggttcagtggcagtgggtctgggacagacttcgactctcatcattagctagactggancctgaagtactttcgctagttgtatttacctgtacgtanacctaagtaattgggaagtttacctaccgttacgtggttccggtttacggacccgaaacggggtaaccctaaaggggttaaacgtaaaacgttaggaaaaaccgtaaaccgttggtaacggggtcctacggacctaaccccgtagttccttaaccggg

SEQ ID NO: 146162 - DNA, 562 bp, Homo sapiens
  misc_feature: GYAE6OF02G14HA.21.4.A04.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatacgcctggtaccagcagaacgcctggccaggcctcccgaggttcccncatctatcgcgtcgggtccccacgcgggcccacgtcggccactcccgagactaggttcaggtggctaggtgggtctgggacagtacttcacgtctcatctatacgacagacgtggacgtctagaagtcgttcgctagttgtattacgtgtcagtagtagtagtaggtaacgttcaccgttcgttcggtcgttccggaccgtaagggtacctaagggtaacgaaagtacgaaacgtacgtgtacggtcgtacgaccacgtactcgtcg

SEQ ID NO: 146163 - DNA, 709 bp, Homo sapiens
  misc_feature: GYAE6OF02J0SBO.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccaggcaccctgtctttgtctccaggggaaangccaccctctcctgcagcctccagccagaatactccagagcctactacatacgcctggtaccagcagaacgcctggccaggtcctccccgaggtttccctcacttcctagtcgcgttcgggtccccacgacggggcccacgtcgggacctactccccgaaggtaccagggtttcaacgggttcggacgtagggtcgggtcgtaggggaaccaggttaccctttacgaccttccgtactaagtaccgtaatttacggctaacgggtacgtacgggaccggtctaacgggtaaagtacgtttcgacgttacggttggttaactttacgtgttaccgagtcggtaaagttacgttacgggtaaacgtttccgtaaccgttccgttacggttcccggtttacgggtacccgaacggggtaacgttaacgggtaaacgtaaacgtaagggtaaaacccgtaacgtttagggtacggtaccgtacggaaccctaaccgttagttcccgttaacg

SEQ ID NO: 146164 - DNA, 690 bp, Homo sapiens
  misc_feature: GYAE6OF02IFR7E.21.4.A04.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (253)..(253): a, c, t, g, unknown or other
  misc_feature (253)..(253): n is a, c, g, or t
tcagtcgtcgctcgcacgaccggtgctcgatttagagtagtgatcagggagagctgctcagttaggacccagagggaaccatggaaacccagcgcagcttctcttcctctgctactctggctcccaggctcagaaaccaccggagaaattgtgttgacgcagtctccaggccaccctgtctttgctccgagggaaancgccacctctcctgcagctcagccagaatatccagagctanacatagcctggtacngacagaagcctggcaaggcctccacggttcctcactctactgcgtcggtcccacgacgggcccacgtcggccaacgttccccgaagtacacggttccaacgttcgggcacgggtttggtcgtggggacaacgtaaccttccgaaccttcgactactacgtacttagacgtaagtccgtaggtacgtacctaggtaacgtacttacggtacaaggtttcgttaagttaacgttgtaccgttaagggccttaagttacgttaggtaacgtttacccgtaccgttaccgtttggtacccgttacgggtacccggtaacggggtaaccccggttaaagggttaaacgtaacggttaaaccggtaaaaccggaaaccggttttcggtaaccgggtaacgtttccggtaaacccgtaacgttacccggtttacgtttacccgg

SEQ ID NO: 146165 - DNA, 768 bp, Homo sapiens
  misc_feature: GYAE6OF02FFAIP.21.4.A04.1.454.CMB.1.raw
  modified_base (200)..(200): a, c, t, g, unknown or other
  misc_feature (200)..(200): n is a, c, g, or t
  modified_base (315)..(315): a, c, t, g, unknown or other
  misc_feature (315)..(315): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagcctccagccagaactactccaggacgcttaactacatacggccctggtacccagccaaggaacgccgtggcccaggcccttacccgaggtttccctnaacgttcctagtcgcctacggggtcccaacggacggggcccaacgttcgggacctaacgttccccgaaggtaccgtaacgggtttcaacggggttcggaccgttaggggttcggggttaccttagggggaaccctaggttaaccctttccgaaccctttccgtaccgtaattacccgtaagtttaacggaccgtaaaggtaccgttacgggaacgtcccgttaaggtaaacggtacgttttccggaacgttacggtttacgttaactttacgtcggttacgacgtacgtaaggttacgttacgggttaacgtttccgtaacccgttcgttacggtttccggttaccgggaaccggtaacgggaacccgtaaagggttaaacgaaacgttaacgggaaaccgttaagttcggtaccggtactaaccggtacctaccgtacgtttccgttaccgg

SEQ ID NO: 146166 - DNA, 505 bp, Homo sapiens
  misc_feature: GYAE6OF02GLESO.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcccnatctatgctcgggtcccacgngggcccatggccatcccagacaggttcagtggcagtgggtctgggacagacttcactctcatcattagcagacgtggacgcctagaagtatttcgcagtgtattactgtcagcagtataggtagtcactctgtcgttcgaccaggtaccaaggtagaaatagaaacgaacgtgtacggctgacactatcgtcg

SEQ ID NO: 146167 - DNA, 518 bp, Homo sapiens
  misc_feature: GYAE6OF02FPTEE.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaagagccaccctctcctgcagctccagccagaatatccagagctactacatagcctggtaccagcagaagcctggccaggctcccaggttcctcatctatgctgggtcccacgacgggccacgtggcactcccgagacaggttcaggtggcaggtggtctgggacagacttcactctcatcattagcagactggacgcctagaagtatttcgatagttgttattactgtcagcagtagtggtaagttcaccttctgtcgttcggccgagggaccaaggtaagaagtacggaaacgtacgtggtacggctagacactatctcg

SEQ ID NO: 146168 - DNA, 554 bp, Homo sapiens
  misc_feature: GYAE6OF02HYBN4.21.4.A04.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (353)..(353): a, c, t, g, unknown or other
  misc_feature (353)..(353): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagctccagccagaatatccaganctactacatagcctggtaccagcagaagcctggccaggcctcccaggttccncatcctatgctcgggtcccacgacgggccacgtggcactcccagactaggttcagtggcnggtgggtctgggacagtacttcactctcatcatagcagacgtggacgcctagaagtagtttcgctagttgtattacgtgtcagtcagttagtagtaagttccaccttcgtgttccggttaccgggaccgtaacggggaccgtaagggtaagaaagtacggaaacgtaactaggtacggacgtagacctactacgttctacg

SEQ ID NO: 146169 - DNA, 595 bp, Homo sapiens
  misc_feature: GYAE6OF02IPH87.21.4.A04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (315)..(315): a, c, t, g, unknown or other
  misc_feature (315)..(315): n is a, c, g, or t
  modified_base (380)..(380): a, c, t, g, unknown or other
  misc_feature (380)..(380): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatactccagagctactacatagcctggtaccagcagaagcctggccaggcctcccgaggttccncattctatgcctgggtccccacncgggcccacgtggcactcccagacaggttcagtggcaggtggtctgggacagacttcactctacntcatagcagctggacgcctagaagtcgtttcgactagttacgtatttacgtgtacgagactaaggttatagggtaacgtttccaacccgttcgttcggttaccggttaccgggtacccgaacgggtaacccgtaaagggttaacgaaaagttacggtaaaaccgtaacgttacggtacggtacgtaccgaccgtaacccgtacgttccgttaccg

SEQ ID NO: 146170 - DNA, 502 bp, Homo sapiens
  misc_feature: GYAE6OF02G0RGM.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccacgtggcatcccagacaggttcagtggcagtggtctgggacagacttcactctcatcattagcagactggagcctagaagtatttcgctagtgttattactgtcagcagtatggaagttcaccttctgtcgttcgccgaagggaccaaggtagaaagtagaaacgaacgtgtaggctagcacatctcg

SEQ ID NO: 146171 - DNA, 624 bp, Homo sapiens
  misc_feature: GYAE6OF02FNPB0.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtccacgcgggccacgtggcactcccagacaggttcagtgcgaggtggtctgggacagtacttcactctcatcattagcagtacgtggacgtccgtagaacgtacgtttcggacgtaggttagttactttaacgttcgtaccaggtacctaaggttacgtagggtaacgtttccgtaccgttcgttacggttccgggtttaccggacccggtaacggggtaacccgttaaagggttaaacggtaaacgttaacgggtaaaaccggtaacgtttaggtacgggtaccgttacggaccgtaacccgtacgttaccgttttaccgg

SEQ ID NO: 146172 - DNA, 892 bp, Homo sapiens
  misc_feature: GYAE6OF02GF1B1.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanacgcccaccctctcctgcagcctccacgccaagaatactccaagacgtcctaactacatacgccgtacggtaacccagaccaaggaacgtcccgtacgggacccgaacgggtcccttaccccggtaacgggttttcccctacgtaacttccttaagtcggtccggttccggggtacccccaacggaccgggggtacccctaacggttcgggaccctaaccgtacccccgaaaggtaaccgttacggtttaccgaaggggttcgggaccgtaaggggtttcggggttcggtacggggaacctaacggttaccctttaccgaaccgtttaccgtacgtaacgtttaccgtaagtttaaccggaccgtaacggtaaccggttacggggaaccgtacccgttaagggtaaacggtttacgttttaccggaacgttaacgggtttacggtttaaaccgtttaccgttcggtttaaccgaacggtaccggttaaaggtttacgttaacggggttaaaccgtttaccctaacccgtttaccggtttacgggtttacccgggtttacccggggaacccggtaaacgggggtaacccggttaaaggggttaaacgtaaaacggttaacgggaaaacccggttaacggttacgggtacggtaccgttaccggaacccgtaaccgttacgttccgttaaccgg

SEQ ID NO: 146173 - DNA, 610 bp, Homo sapiens
  misc_feature: GYAE6OF02IIU04.21.4.A04.1.454.CMB.1.raw
  modified_base (215)..(215): a, c, t, g, unknown or other
  misc_feature (215)..(215): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (472)..(472): a, c, t, g, unknown or other
  misc_feature (472)..(472): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcagctggtggagtcgtggggganacttggtccagcctggacgggtccctgagactctcctgtgcagcctntgcattcaccttnagtcaccacaacatggactgggtccnccaggcctcgaggggaggctggagtgggcgcgtatacgaaggaanctaanagtacagtacagaatacggcgcgtctaggtacgaaaggtacggttcaaccgtatcctaacgaagaagtataggtaattacgaaaagtaacctcgtaacttagtaatcctagactaaaagtnaaaccgacgacccgtaagaaaaacccggnggaaaccaccgggtaccttagtagtttagttcgggtaaggtaacgaaacgtaaaagggtcgttaggggtaacgttcgggttagggtagggtaacgtcgttaggtaacgg

SEQ ID NO: 146174 - DNA, 491 bp, Homo sapiens
  misc_feature: GYAE6OF02GNOLX.21.4.A04.1.454.CMB.1.raw
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccanagggccactggcatcccagacaggttcagtggcaggtggtctgggacagacttcactctcatctattagcagactggacgcctagaagtatttcgctagttgtattacgtgtcagcagtatggtaattcacctntgtcgtcgcgaggacaaggtanaatgaaacgtatgtgctgcacatctcg

SEQ ID NO: 146175 - DNA, 594 bp, Homo sapiens
  misc_feature: GYAE6OF02IOENC.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatatccagagctactacatagcctggtaccagcagaagcctggccaggctcccgaggttcccnattctatgctcgggtaccccagacgggccacgtggaccacgtcccagacgtaggttccaggtggctagggtcgggtcgtggggactagtaccttcgacttctcatctattagctaagacgtggacgtcctaggaacgtatttccgactaggttgttaacttacgtgtcgtagtacgtagttagtggtaagttccgtaaccttcgttacgtccggttacgaccgtaagggacctaaagggtaagtaaacgtcggaaaaccgtacgttaggtacggacttacggaccgtacctacgttcgttcgg

SEQ ID NO: 146176 - DNA, 514 bp, Homo sapiens
  misc_feature: GYAE6OF02G1G7D.21.4.A04.1.454.CMB.1.raw
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (446)..(446): a, c, t, g, unknown or other
  misc_feature (446)..(446): n is a, c, g, or t
  modified_base (487)..(487): a, c, t, g, unknown or other
  misc_feature (487)..(487): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccagggaagggctggagtgggtcgaccgtatacgaaggaaagctaacgagttaacagtaacagaatacggcgcgtctgtagaaaggagttcacatcnaagagatgattacaaaagactcactgtatcnacaaatgaacngacctagaaaccgaggacaacggctagtattagtgaggtanacaaagagtgatggtgnggangtgacg

SEQ ID NO: 146177 - DNA, 850 bp, Homo sapiens
  misc_feature: GYAE6OF02IMNBN.21.4.A04.1.454.CMB.1.raw
  modified_base (208)..(208): a, c, t, g, unknown or other
  misc_feature (208)..(208): n is a, c, g, or t
tcagtcgtcgctcgcacgaccggtgctcgattttagagtagtgatcgaagggggagagctgctcagtttaggaccccagagggaaccatcggaaaccccagcgcagcttctcttcctcctgctactctggctcccaggctcaggaaaccaccggagaaattgtgtttgacgcagtctccaggcaccctgtctttgtctccaggggaangccaccctctccgtgcagctccaggcccagaatatccagagctactacatagcctaggtaccagtcagaacgcctggcccaggccttccccgacggtttccctcgaacttccgttaagtcggcctttcggggtccccaacgggtacggggcccctaacgttcgggaccaacgttaccccgaaggtaccgtacgggtttaccaaggggtttacggtcccgtaaggggtttccgggggttcccttagggggggaaaccctaacggggttaaccccgtttttaccggaacccttttacccgttacccgtaaacttttacccgtaaacgttttaaacgggaccccgtaaacgggtaacccggttacggggtaaaccggtaccccgttaagggtaaacggttacgttttttaccggaccgttaaacgggtttacggtttaaacgttttaaccgttacgggttaccgtaacggtacgtaaacggttacggtacgggttaaacggtttaccgtaacccgtttcgtttacgggttaccgtttaccgggtaacccgtaacggggtaaccgtaaacgggttaacggaaacgttacggaaaaccggtaacgttaggtacggtacgttacgtacctaaccgtagtaccgttacg

SEQ ID NO: 146178 - DNA, 513 bp, Homo sapiens
  misc_feature: GYAE6OF02GBO3U.21.4.A04.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (289)..(289): a, c, t, g, unknown or other
  misc_feature (289)..(289): n is a, c, g, or t
  modified_base (510)..(510): a, c, t, g, unknown or other
  misc_feature (510)..(510): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccaganctactacatagcctggtaccagcagaagcctggccaggctcccaggttccncatctatgctgggtccccagagggccactggccatcccagacgaggttcagtggcaggtggtcgtggacgagacttcactctcatctattagcagacgtaggagccgtagaagtattcgtcgtagttagttattactcgtctagctagtagtagaagttctacctctgtcgttcgccgaggacgaggtaagaatagaacgtaacgtgtagcgtgcactatntcg

SEQ ID NO: 146179 - DNA, 506 bp, Homo sapiens
  misc_feature: GYAE6OF02FF2UF.21.4.A04.1.454.CMB.1.raw
  modified_base (200)..(200): a, c, t, g, unknown or other
  misc_feature (200)..(200): n is a, c, g, or t
  modified_base (443)..(443): a, c, t, g, unknown or other
  misc_feature (443)..(443): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccctcatctatgctgggtccccacgacggggccacgtggcatcccagacaggttcagtggcaggtggtctgggacagacttcactctcatcattagcagactggagcctagaagatttcgcagttgtattactgtcagcagtatggaagttcacctntgtcgttcgcctagggaccaagggtaagaatacgaaacgtactagtcggctgacaccatctcg

SEQ ID NO: 146180 - DNA, 590 bp, Homo sapiens
  misc_feature: GYAE6OF02HS16E.21.4.A04.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagtcagaatatccagagctactacatagcctggtaccagcagaagcctggccaggctccaggttcctcatctatgctgggtccccagacgggccacgtggcactcccagacaggttcaggtcggctaggtgggtctggggacagtaccttcactctcaatcattagcagactgganctgaagtatttcgctagttagtacttaatgtacagtctaaggtagtaggtaacgtttccaccgttcgttacggttccggtttaccgggaccgtaaacgggggtaacctaaagggttaaaggaaaacgttacggaaaaccggtaacgtttcgggtacggtacgtacggtacgtaacgttaccgtatttacccg

SEQ ID NO: 146181 - DNA, 617 bp, Homo sapiens
  misc_feature: GYAE6OF02J2TU5.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagccctgggcccaggcctccccgaggtttccctcatccttatcgccgtacggggtccccaacgacggggcccaacgttcgggccaacttccccgaagtaccaagggttttccaagggttcggacctagggttcgggtcctaggggaccacgtactttcgactctcatcagttagcgagactggagcctagaagtactttcgacgtagtgttacttacgtggtacagtctaagttacgtaggtaacgttctaccgttccttaggtccgttaccggaccgtaagggacctaagggtaagtaaacgtcggaaaacgtaccgtagggttgtaccgtgacctaccgtacttcgtacg

SEQ ID NO: 146182 - DNA, 593 bp, Homo sapiens
  misc_feature: GYAE6OF02H1VOF.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagcccaccctctcctgcagctccagccagaatatccagagctactacatagcctgtaccagcagaagcctggccaggctccgaggttcctcatctatcgcgtcgggtaccccacgacgggcccacgtcggaccactcccgaagacctaggttcaggttcggacaggttgggtctaggggaaccagtacttcactctacatctattagactagacgtaggactcgtaggaacgtatttacgctagttgttaatttacgtgtcgagtacgtagtagttaggtaacgttaccgtaccttcgttacggttccgttacggaccgtaacgggaactaagggtaacgtaaagtacggaaacgtaacgttaggtacgtcgtacgactacctataccgtacg

SEQ ID NO: 146183 - DNA, 578 bp, Homo sapiens
  misc_feature: GYAE6OF02I4HQ4.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaacgcctggcccaggcctcccgaggtttccctcattctatgcgtcgggtcccacgacgggccacgtcggcactcccagacaggttcaggtggctaggtggtctgggacagtcttcactctcatctatagcagacgtggacgcgtagagtacttcgactagttagttacttacgtgtacaggtctagtacgtaggtaacgttccgtaccgttcgtcggtttaccgtccggtaaccgtaacgggtaccgaagggtaacgtaaacgtaacggaaacgtaacgttggttacggacgttcggactaccgtagtcgttacg

SEQ ID NO: 146184 - DNA, 517 bp, Homo sapiens
  misc_feature: GYAE6OF02HCVEP.21.4.A04.1.454.CMB.1.raw
  modified_base (200)..(200): a, c, t, g, unknown or other
  misc_feature (200)..(200): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggcccaggctcccaggttcctcatctatgctcgggtcccacgagggccactggcatcccgagacaggttcagtggcaggtggtctgggacagacttcactctcatcattagcagacgtggagcctagaagtatttcgngtagttgttattactgtcagtcagttagtggtaagttcaccttntgtccgttgacctagggactaaggtanaaagttgaaacgtacgtgtggactgacacctatctacg

SEQ ID NO: 146185 - DNA, 508 bp, Homo sapiens
  misc_feature: GYAE6OF02IHBEH.21.4.A04.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttccncatctatgctgggtcccagagggccacgtggcatcccagacaggttcagtggcagtgggtctgggacagacttcactctcatcattagcagactggacgcctagaagtatttcgctagttgttattactgtcagcagtataggtaagttcactctgtcgtcggacagggacctaaggtagaagtagaaacgtacgtgtcggactcgacacctatctcg

SEQ ID NO: 146186 - DNA, 564 bp, Homo sapiens
  misc_feature: GYAE6OF02JQUK3.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
  modified_base (392)..(392): a, c, t, g, unknown or other
  misc_feature (392)..(392): n is a, c, g, or t
  modified_base (559)..(559): a, c, t, g, unknown or other
  misc_feature (559)..(559): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagccctggccaggctccgaggttccncatctatgctgggtccccagagggcccactggccagtcccaagcaggttcaggttggctaggtcgggtctagggacagtacttcactctacgatcattacgntaagctaggacgtcctaggaagtactttcgctagtcgttactacgtgtaccgagaccgtagtagtgggtaacgtttccaccttgtcgttcggttaccgacctacgggaacctaagggtaagaaattacggaaaccgtaacttggtcggcttacgacctacgtacttnttcgg

SEQ ID NO: 146187 - DNA, 655 bp, Homo sapiens
  misc_feature: GYAE6OF02JYFI0.21.4.A04.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
tcagtcgtcgctcgcacgaccggtgctcgatttagagtagtgatcagggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctntcctacagcctccagccagaatatccagacgctactacatacgcctggtaccagccagaacgcctggccaggcctcccgaggttccctacgactctatcgcctgggtccccagaccgggccacgtcggcataccccgagacgtaggttcaaggttcggctaggtcgggtcgtaggggacacggtaactttccgaacgttcctaccagttactacgtttacggcctaagaccgtagggaacgtcccgtaggtaaagtaccgttttccggactacggtttagtactttaacgtcgtactacggtacttaagtacgttagggtaacgtttcctaccgttacgtacgttccggttaccggaccggtaaacggtaccgtaaggggtttaaacaaacggttacgaaacgtaaccgttaggtacggacgttggacctaaccgtagttcgtcttacg

SEQ ID NO: 146188 - DNA, 730 bp, Homo sapiens
  misc_feature: GYAE6OF02J2KPP.21.4.A04.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (291)..(291): a, c, t, g, unknown or other
  misc_feature (291)..(291): n is a, c, g, or t
  modified_base (634)..(634): a, c, t, g, unknown or other
  misc_feature (634)..(634): n is a, c, g, or t
  modified_base (667)..(667): a, c, t, g, unknown or other
  misc_feature (667)..(667): n is a, c, g, or t
  modified_base (723)..(723): a, c, t, g, unknown or other
  misc_feature (723)..(723): n is a, c, g, or t
tcagtcgtcgctcgcacgaccggtgctcgatttagagtagtgatcagggagctctgagagcggagcccagcccagaattcccaggtgtttcatttggtgatcagcactgaacacgagaggacctcaccagtggagtttgggctagagtcgttgggtttttcctgtttagtttattttacgaaggttgtccgagttgtgaggtcncgngtcgttggtaggtcgtcggtggggactcgttcgggtccaggtccgttaggcggttcctgacgtctcgtcgtgtcgcacgtcctnacgtctacttcgaccttcgacgtacaaccaccgtaagtggtccggtaccgttcgggtaccccgcgtaacggttccggtacccggaaagggggtcccggggtgtaacggggtccgggttcgggttacccgggtacctaaaggttaaccgaaaaggtaccgtactaaacggttaacgttaacgaacgtaaccggtaaagtaaccgggtcgggttccgacggtttcgaagtaagggtaaccggtacttaccacgtagttcgaacgtagaccgtaagttacggaacttaacgaaacgttacctaccgagttagtactacggtataaccgaagttacgaacgtaaacnccggtaacaaacgacgtacgtaatcggtacgtntaacgtttagaacggtagaacgtaacgtagtggttagagtcggttaagcggttacngtaacgg

SEQ ID NO: 146189 - DNA, 517 bp, Homo sapiens
  misc_feature: GYAE6OF02GULMK.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagcctccagccagaatatccagagctactacatagcctggtaccagcagaagcctggccaggctcccgaggttccctcatctatcgcgtcgggtcccacgacgggccacgtggcactcccagaccaggttcaggtggctaggtgggtctgggacagtacttcactctcatctattacgcagacgtggacgccgtagaacgtatttcgctagttgttattactgtcagcagtatggtatcactgtgtcgtcgacgaggacaaggtagaatagaaacgtagtgtaggctgacactatctacg

SEQ ID NO: 146190 - DNA, 771 bp, Homo sapiens
  misc_feature: GYAE6OF02I4Y32.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanacgccaccctctcctgcacgctccagccaagaatactccagagctaactacatacgcctggtaccagcaagaacgcctaggccaggcctcccgaggttcctcattctatcgcgtcggtaccccagacgggcccacgtggacctacgtccccgaagtaccgaacgggtttccaagggttcgggacctaggggtttcggggtaccgttacgggggaaaccctaggtaaccctttccgaacctttccgtaccgtaacgttactaaacggtttacggacccgtaacggaacgttcggggaacgtccggttaacggaaacgttacgttttaccgaccggtaggttacgtttaacgtttaacgtacggtacgaacggtcgtaaacggtttacgtacgggttaaacgttaccgttaaaccgttcgtttacggttaccggttaacccgggtaaccgtaaaccggggtaacccggtaaaggggttaaacggtaaaaacgttacgggaaaaacccggtaacgtttaacgggtacgggtacctttacgggaacccgtaacccgttaacgttaccgttaccgg

SEQ ID NO: 146191 - DNA, 555 bp, Homo sapiens
  misc_feature: GYAE6OF02HEUYN.21.4.A04.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaanagccaccctctcctgcagcctccagccaagaatatccagagctactacatagcctggtaccagcagaagcctggccaggcctcccaggttccncatctatgctcgggtcccacgagggcccacgtggccactcccagacaggttcaggtggcaggtgggtctgggacagaccttcacttctcatcattacgcagactggacgccgtagaagtactttcggactagttgttaacttctgtacagtctagttagtaggtaacttcaccttgtcgttcgttcggaccgtaagggacctaagggtaacgaaagtaggaaaccgtacgttggtacggcgtacggacctaccgtatcgtacg

SEQ ID NO: 146192 - DNA, 576 bp, Homo sapiens
  misc_feature: GYAE6OF02HUHNJ.21.4.A04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatactccagacgctaactacatagcctggtaccagcagaacgcctggccaggcctccgaggttccncatctatgcgtgggtcccacgacgggccacgtggcactcccgagacaggttcaggtggcaggtgggtctggggactagacttcgactcgtcatctattagcagacgtggactccgtagaacgtatttcgcgtagttgttacttacgtgtacagtctaagtacgtaggtaacgttcgaccttcgtgttaccggttcggaccgtaacgggaaccgtaaagggtaacgtaaacggtaacgaaaaccgtacgtaggtacggtcgtacgaccgtaactagtcgtacg

SEQ ID NO: 146193 - DNA, 712 bp, Homo sapiens
  misc_feature: GYAE6OF02JJNA9.21.4.A04.1.454.CMB.1.raw
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccacccgtctcctgcagctccagccagaatatccagagctacacatacgcctggtaccagcagaagcctggccaggctcccgaggttccncatctatgcgtcgggtccccacacgggccaactgggccagttccctaagacctaggttccgaagttcgggaccgaggtttcggggtccgtgggggtaaccaacggtaaccgttttccaaccgtttccgtttaccactttacgaacgttttaacgaccgttagaaccgttcggaacgtacccgtaggtaaacgtacttttaaccggtcgtaaggttacgttaacgtttcgtacgttccgaacggtcctaaggttaacgtacggttaacggtttaccttaaccgttccttcggttaccggttttaccgggacccgtaaggggtaacccgtaaagggttaacgggtaaaactcggggtaaaaaccgtaacgttaacgggttcgggtaccgttcggaaccgtaacccgtacgttaccgttacgg

SEQ ID NO: 146194 - DNA, 521 bp, Homo sapiens
  misc_feature: GYAE6OF02IO742.21.4.A04.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
  modified_base (452)..(452): a, c, t, g, unknown or other
  misc_feature (452)..(452): n is a, c, g, or t
tcagtcgtcgctcgcacgaccggtgctcgatttagagtagtgatcagggggagagctgctcagttaggacccagagggaaccatggaaacccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatcccagagctactacatagcctggtaccagcagaagcctggccaggctcccaggttcctcatctatcgctcgggtcccagacgggccacgtggcactcccagacaggttcagtggcaggtgggtctgggacagacttcactctcatcattagcagactggagctgaacgtntttcgcgtagtagttattactgtcagcagttataggtaattcaccttntcgttccgtcgaccgaggaccaaggtaagaaagtagaaacgtacgtagtcggactgaccactatctacg

SEQ ID NO: 146195 - DNA, 579 bp, Homo sapiens
  misc_feature: GYAE6OF02IG3XP.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaantccaccctntcctgcagctccagccagaatatccagagctactacatagcctggtaccagcagagcctggccaggctcccaggttccncatcctatgctcgggtcccacagggcccagtggcactccagacnggttcagtgcagtgggtctgggacagacttcacgtctcgatcagttagcagactggacnccgtagaagtatttcgactagtacgttacttagtgtccagtacctagtacgtaggtaacgttcgaccttcgtacggttccgtttaccgggaccgtaacgggtacccgtaagggtaaacgtaaagttaacggaaacgttaacgtagggttacggacgtaccggtaactaaccgtacgtaccgtttacgg

SEQ ID NO: 146196 - DNA, 567 bp, Homo sapiens
  misc_feature: GYAE6OF02G0ATR.21.4.A04.1.454.CMB.1.raw
  modified_base (200)..(200): a, c, t, g, unknown or other
  misc_feature (200)..(200): n is a, c, g, or t
  modified_base (385)..(385): a, c, t, g, unknown or other
  misc_feature (385)..(385): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatactccagagcctaactacatagcctaggtaccagcagaagcctggccaggcctcccaggttcctcatctatgcgtcgggtccccacgagggcccacgtcggccactcccgagacaggttcaggtggcaggtggtctgggacagtcttcgacttcncatctattagcagacgtggacgcgtagaagtagtttcgcgtagttgttattacgtgtacagtacgtagttagtaggtaacgtttccaccgttcgtcggttcgttaccggaccgtacgggtaccgaagggtaagaaatacggaaacgtacgttagtacggctcggacctacgtactcgttacg

SEQ ID NO: 146197 - DNA, 525 bp, Homo sapiens
  misc_feature: GYAE6OF02GINFL.21.4.A04.1.454.CMB.1.raw
  modified_base (200)..(200): a, c, t, g, unknown or other
  misc_feature (200)..(200): n is a, c, g, or t
  modified_base (406)..(406): a, c, t, g, unknown or other
  misc_feature (406)..(406): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanacccacctctcctgcagctccagccagaatatccagagctactacatacgcctggtaccagcagaagcctggccaggctcccaggttcctcatctatgctgggtcccacgacgggccacgtggcactcccagacacggttcagtggcaggtgggtctgggacagtacttcgactctcatcattagcagactggagtcctagaagtnttcgactagtagttattacgtgtcagtacagtatggtaagttcacttctgtcgttcgacgaaggacaaggtagtaaagtgtaaacgaacgtgtaggctacgacctacgattcgtgttcc

SEQ ID NO: 146198 - DNA, 499 bp, Homo sapiens
  misc_feature: GYAE6OF02FYP74.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctntcctgcagctccagccagaatatccagagctactacatagcctggtaccagcagaagcctggccaggctcccaggttcctcatctatgctgggtcccacagggccactggcatcccagacaggttcagtgcagtggtctgggacagacttcactctcatcattagcagactggacgccgtagaagatttcgactagtgttattactgtcagcagtatggaagttcacctctgtcgttcggacacgggaccaaggtagaaagtagaaacgaagtgtggactgacacatctcg

SEQ ID NO: 146199 - DNA, 509 bp, Homo sapiens
  misc_feature: GYAE6OF02GEOY6.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgctgggtcccacacgggccacgtggcatcccagacaggttcagtggcagtgggtctgggacagacttcactctcatcattagcagactggagcctagaagtatttcgctagttgtattactgtacagcagtataggaattcaccttctgtcgttcggacgaagggaccaaggtagaaagtgaaacgtaacgtgtaggctagacactatctcg

SEQ ID NO: 146200 - DNA, 584 bp, Homo sapiens
  misc_feature: GYAE6OF02HEBMJ.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctcgggtcccacgagggccacgtggcactcccagacaggttcaggtggctaggtcggtctgggacagtacttcactctcatcattagcagacgtggacgcgtagtaagtactttcgacgtagttgttattacgtgtcagctagtagtaggtaacgttcaccgttcgtacggttccgttacgggaccgtaacggggaccgtaaagggttaacggtaaacgttaacgggtaaaaccggttaacgttagggtacggtaccgttacggaccgtaacctacgttcgttacgg

SEQ ID NO: 146201 - DNA, 670 bp, Homo sapiens
  misc_feature: GYAE6OF02HKTA1.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgtctttgtctcagggaangccacctctcctgcagctccagccagaatatccagagctacacatacgcctggtaccagcaagaacgcctggaccagggcctccccgaggtttccctacacttctacgtcgccgttcgggtaccccaaggacggggcccctaacgttcgggacctacgtccccgaaggaccgtacgggttcaaggtcggactagggttcgggtctaggggaacctaggtacctttcgaccttccgtacatctagtttacgctaagaccgtggacgtcgtagaacgtactttcgacgtagttacgttacgttacgtgtacctaggtacgtacggttagtacggttaacgtttccgaaccgtttccgttacggttaccgttaccggaccgtaacgggtaccgtaaagggttaacgaaacgttacggaaaaccgttacggtaggttacggtaccttacggacccgttaaccgtacgttaccggttacg

SEQ ID NO: 146202 - DNA, 545 bp, Homo sapiens
  misc_feature: GYAE6OF02FUWX0.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatcgctgggtcccagagggccacgtggcatcccagacaggttcagtggcaggtgggtctgggacagacttcactctcatcattagcagtactggacgccgtagaagtagtttcgacgtagttgttattacgtgtacagtcagttagtaggtaagttccaccttctcgttcgttcggaccgtaacgggaccgtaaggtaagaaacgtacggaaacgtaacgtaggtacggacgtacgactaccgtatcgtcg

SEQ ID NO: 146203 - DNA, 511 bp, Homo sapiens
  misc_feature: GYAE6OF02G0XOV.21.4.A04.1.454.CMB.1.raw
  modified_base (200)..(200): a, c, t, g, unknown or other
  misc_feature (200)..(200): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagagcctggccaggctcccaggttcctcatctatgctgggtcccacagggccactggcatcccagacaggttcagtggcaggtgggtcngggacagacttcactctcatcattagcagactggancctagaagtatttcgctagttgtattactgtcagctagtatggaagttcacttctgtcgttcgaccagggaccaagggtacgaaagtagaaacgtacgtggtacggctagaccacctatcttcg

SEQ ID NO: 146204 - DNA, 595 bp, Homo sapiens
  misc_feature: GYAE6OF02GXA6G.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngcccaccctctcctgcagctccagccagaatactccagagctactacatagcctggtaccagcagaacgcctggccaggcctcccaggttcctcatctatgcctcgggtccccagcgggccacgtggcacgtcccagacaggttcaggtggcgtaggtcgggtctgggacagtacttcacttctcatctattagactagacgtggacgcctagaagtacgtttcgcgtagttgttaattcgtgtcagtacagttagtaggtaacgttcaccgttcgttcggttccggttccggaccggtaacgggaccgtaaagggtaacgtaaacgtaacggtaaaaccgtaacgttacgggtacggtacgtacggtaccgtaaccgtacgttccgttacgg

SEQ ID NO: 146205 - DNA, 633 bp, Homo sapiens
  misc_feature: GYAE6OF02JJTMQ.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccagggaaangccacctctccagcagctccagccagaatatccagagctactacatagcctggtaccagcagaagcctggccaggctcccaggttcctcatcctatcgctgggtccccagtacgggccaacgttggaccagtccccagacagggtttccagttggcaggttgggtctggggaacagtaccttcgacttcgtactatcgaactttaggcaagtacgttgggaactccgttagaaacgtatttccggacgtaagttcgttagttacttaggtctaacgcgtaaggtacgtttagggaaggtttcctaacccgttcgttacggttacccgggttcgggtaccctaaggggtacctaaacgggttacggtaaaacttaggggaaaacctaacggtttcggaacggttccgtaaggtacctaaccgtacttcgttaacgg

SEQ ID NO: 146206 - DNA, 504 bp, Homo sapiens
  misc_feature: GYAE6OF02G3L9Z.21.4.A04.1.454.CMB.1.raw
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccaagagctactacatagcctggtaccagcagaancctggccaggctcccaggttcctcatctatgctgggtcccacgagggccacgtggcatcccagacaggttcagtggcaggtggtctgggacacgacttcactctcatcattacgcagactggagccgtgaacgtagttcgcgagtgtaattactgtcagcagtatgattcacttctgtcgtcgacaggaccaaggtagaaatacgaaacgacgtagtacggctagcactatcgtacg

SEQ ID NO: 146207 - DNA, 552 bp, Homo sapiens
  misc_feature: GYAE6OF02JUL35.21.4.A04.1.454.CMB.1.raw
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
  modified_base (475)..(475): a, c, t, g, unknown or other
  misc_feature (475)..(475): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctcngcattcaccttcagtnaccacaacatggacgtgggtccgccaggctccgaggggagggctggagtgggtcgcgtatacgaaaggaagctaacagttacagtacagaatacggcncgtctgagaaaggagttcaccatctacagagtatnaattacaaagactacaacgtgtaatcaggactaaaacgtgaaccaggaccttaggaaaaccgnggaaccacgggacctgttattagtggtaaggtaacaacgaaagtcgtaggacgttgaggttggaacgtcgtagtacg

SEQ ID NO: 146208 - DNA, 575 bp, Homo sapiens
  misc_feature: GYAE6OF02H7CKH.21.4.A04.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatanccagagctactacatagcctggtaccagcagaagcctggccaggcctccaggttccncatctatgcctggtcccagacgggccaactggcactcccagacaggttcaggtggcaggtgggtctggggacagtacttcacgtctcagtactattagacagactggagcctaggaagtntttcgactaggtntacgttactgtcagaccgtagtacgtagggaattccaaccgttcgttaggttccggttaccggaccgaaggggtaccctaagggtaacgtaaacgtacggtaaaaccgtaacgttggtacggacttacggacctaaccgtacgtacgttaccg

SEQ ID NO: 146209 - DNA, 629 bp, Homo sapiens
  misc_feature: GYAE6OF02I10SP.21.4.A04.1.454.CMB.1.raw
tcagtcgtcgctcgcacgaccggtgctcgatttagagtagtgatcagggggtaggagctgctcagttacggacccagaggggaaccatggaaaccccagcgcagcttctcttcctcctgctactctggctcccaggctcaggaaaccaccggagaaattgtgttgacgcagtctccaggcacccgtgtctttgtctccgaggggaaagcgccaccctctcctgccagctccagccaacgaactactccaagacgtactaactacagtacgccgtggtaccagacgagaacgcctggccaggcctcccgaggttccctacacttctattcggccgttcggggtccccacgacggggcccacgtcggacactcccgaagaccgtaggttcagtggctagggtgggtctgggacagtcttcgactctacatctagttagacagtacgtggacgtccgtagaagtacgtttcgactaggttagttacttacgtgtacgagtacgtaggttagtaggtaacgttccgtaccttcgtcggttccgttaccggaccgtaacgggaccgtaaggtaaggtaaacgtaacggaaaccgtaacgtggtacggacctacgtacccacgtacgtcgttacg

SEQ ID NO: 146210 - DNA, 616 bp, Homo sapiens
  misc_feature: GYAE6OF02IRNUL.21.4.A04.1.454.CMB.1.raw
  modified_base (200)..(200): a, c, t, g, unknown or other
  misc_feature (200)..(200): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggtttccnattctatcgcgtcgggtcccagacgggccacgtggacacgtcccagactacggttcaggtggcaggtggctgggacagtacttcactctcgtatcattacgcagacgtggacgcgtagtacgtacgtttcgacgtaggttgttaacttacgtgtacctaacgtacgttaaggttacggtaacgttaccgttaccgttaccgtttacggttcggtttacggttaccgggtaaccggtacggtaacggtaacggtaaagtaaacggtaacgtaaacggtacgttacggtacggtacgtaccgaacccgtaacgttacgtacgttaccg

SEQ ID NO: 146211 - DNA, 580 bp, Homo sapiens
  misc_feature: GYAE6OF02JB1FH.21.4.A04.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagacgccaccctctcctgcagctccagccagaactactccagagctactacatagcctggtaccagcagaacgcctggcccaggcctacccgaggttcccncatctaatcgcgtcgggtcccacgacgggcccacgtggccacgtcccagactaggttcagtcggcaggtgggtctgggacagtaccttcacttctcatcattacgcacgtactggacgcctaggaactgttacgacgtagttgttattacgtgtacagtctagtagtaggtaacttcgtaccttcgttcgttccggttcggaaccgacgggtaaccgtaagggtaacgaagtaacggtaaacgtacgtggtacggtacgtagacctaccgtacgtctacg

SEQ ID NO: 146212 - DNA, 527 bp, Homo sapiens
  misc_feature: GYAE6OF02I86OY.21.4.A04.1.454.CMB.1.raw
  modified_base (200)..(200): a, c, t, g, unknown or other
  misc_feature (200)..(200): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccagaggccactggcagtcccagacaggttcagtgcagtggtctgggacagacttcactctcatcattagcagactggagcctgaantttcgcagtgtattactgtcagcagtagtaggtaattcaccttcgtcgtcgttcggaccgtaagggtaactaagggtaagaaacgtaggaaaccgtaacgttggtacggtactagaccgtaacctagtcgttacg

SEQ ID NO: 146213 - DNA, 780 bp, Homo sapiens
  misc_feature: GYAE6OF02JP1ZE.21.4.A04.1.454.CMB.1.raw
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccaggcctggagggtccctggagactctccgtgtgcagcctntgcattcaccttcagtgaccanaacatggactgggtccnccaggcctaccgaggggaacgggctgggagtgggtccggccgtataacgaaggaaacgctaaacgagttaacgagtaacgagaagtacggacgcgtacgtggtacgaaagggtacggttaccaaccgtattaccgtacgaaaggtaacgtagttacgtaaacgttaaccgaaaaggtaaaccctcgtaaaccttagggttaaactaccgttaacggaacctaaaaaggttaccggaaaacctaacgggaaccccgttaaagggaaaaaaaaccccgggtcgggtaaaacccggtaaacccggggttacccggtttaaggtttaaacgtttttaaacggttaacccggggttaaggggtttaaaacgggaaaccggtaaaaaaaacgggttcgggtttaacgggggttaaaccgtttaggggggtttaaccgggtttaagggggtttaaaccggtaccgtttaggggttaaacccggg

SEQ ID NO: 146214 - DNA, 733 bp, Homo sapiens
  misc_feature: GYAE6OF02J28WN.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctggtggagtcgtgggggagacttggtccagccttgggagggtccctgagacgtctccctgtcgcagcctctgcattcaccttcagtgaccacaacatcggactcggtccgccgaggcctaccgaggggaacggggcgtagggacggtggggtccggtccggtaagttaacgaaggaaacgtaccgtaaacgtagttaacgaagtacaaggaacgttacggcgtacgtcgtgggtagaaagggtaacggttacaacccgtagttccgtaacgtaaaggacgtaagttaacgaacgtttaaccgaaaagtaaccgttacctaaacgttacgtaacttacgtaccgaacgtaaaattaccggaaaacctaacgggtaacccttaacgggaaaaaacccgggaacgggtaaacccgtaacggggtaacccggttagttaacgttaagtttacgggtaacgggtaaacggtaaacgtaaaagggtaacggtaacgggtaagttacgggtacgggttggttaacggacggttaggttaaccggg

SEQ ID NO: 146215 - DNA, 519 bp, Homo sapiens
  misc_feature: GYAE6OF02I0Y21.21.4.A04.1.454.CMB.1.raw
  modified_base (200)..(200): a, c, t, g, unknown or other
  misc_feature (200)..(200): n is a, c, g, or t
  modified_base (457)..(457): a, c, t, g, unknown or other
  misc_feature (457)..(457): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccctcgacttctagtcgctcgggtcccacgaggggccacgtggcatcccgagacgaggttcaggtcggcaggtgggtctgggacagacttcactctcatcattacgcagactggagcctagaagtatttcgactagtgttattactgtcagcagtataggaagttcacttntgttcgtcggaccagggactaaggtagaataggaaacgacgtagtggactgacactatctcg

SEQ ID NO: 146216 - DNA, 653 bp, Homo sapiens
  misc_feature: GYAE6OF02I9EHJ.21.4.A04.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggtttcctgttgttattttacaaggtgtccagtgtgaggtgcagctggtggagtcgtgggggagacttggtccagccgtgggacggggtccctggacgtacctctcctgtgccaggccttcngctattccacctttcagtcgaaccacaacagtgggactcgggtccgccgaggcctaccggaggggtaacgggggcgtggggaggtcggggtccgggaccgtaattaaccgaaaggaaagtactaaacgagttaaccaagtaactaaggaaactaccgggcgtaccgttcgtagggtaaggaaagggtaacggttaccaaccgtactacgtacgaagtaagaatagtaacttacgaaaagtaacctactacgtgtaactcgtagtacaaagtacgaacacgaccgtaaggaaaccgagaacgaccgacgtacgtagttagtaggtaggtaagaacgaaaggtagtaggtacgtgggttaggtaggtaggtacgtagtacgg

SEQ ID NO: 146217 - DNA, 638 bp, Homo sapiens
  misc_feature: GYAE6OF02JR8MM.21.4.A04.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (378)..(378): a, c, t, g, unknown or other
  misc_feature (378)..(378): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcacctgtctttgctcaggggaaangccacctctcctgcagctccagccaagaatactccagacgctactacatacgcctggtaccagcagaacgccgtggccaggctcccgaggtttcccncgatctacgtcgcgtcgggtcccagacgggccacgtcggcactcccgaggacgtacggttcaggttcgacgtaggttcgggtcgngggaactaggtaccttcacgttcgtcatacgtacgtacgcaggtacgtggacgtcctagggtaacgtacgtttcgacgttaggttacgttaacttacgttcgtacgacggttacgaaggttacgttacgggtaacgttctaccgttcgttcggttaccggttccgaccgtaacgggtaccgtaaagggtaacgtaaacgtaacggtaaaaccgtagttacggtacggtacctacggtacctaccgttagtacgttaccgg

SEQ ID NO: 146218 - DNA, 570 bp, Homo sapiens
  misc_feature: GYAE6OF02INU8X.21.4.A04.1.454.CMB.1.raw
  modified_base (445)..(445): a, c, t, g, unknown or other
  misc_feature (445)..(445): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaacgcctggccaggcctcccgacggtttccctcacttctatcgacctgggtccccagacgggccagtcggcactcccagacaggttcaggtggacaggtgggtcgtagggacagtaccttcgacttcgctatcagttacgcgaagtacgtggtacgcctaggaacgtatttcgactagtnttattacgtgtcagctagtagtaggtaacttccacttcgtgttccggtcggaccgaagggaccgtaagggtaagaacgttacggaaacgtaacgttggacggtctacgactaacgtagttctacg

SEQ ID NO: 146219 - DNA, 796 bp, Homo sapiens
  misc_feature: GYAE6OF02IIKHC.21.4.A04.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcgaggggagagctgctcagttaggacccagagggaaccatggaaaccccagcgccagcttctcttcctcctgctactctggctcccaggctcagaaaccaccggagaaattgtgttgacgcagtctccaggccaccctgtctttgtctccaggggaaangccaccctctcctgcagctccagccagaatatccaganctaactacatagcctggtaccagcagaagcctaggccaggctcccaggttccncatctatgctcgggtcccacgagggcccaacgtcgggacctactccccgaagaccgtaggtttcaaggttgggcctaagggtttcggggtacgttagggggaacctaaggtaccctttaccgaaccttccgttaccgaactttaccgtaacgttttaacggaccgtaaggtaacccgttacggggtaacgtcccgttaaggtaaacgtttacgttttaccggtaaccgttaaacggtttacggttttaaacttttaaccgtttacggttaaccgtaaggtacccgttaaacgggtttaaccgttaacggggttaaacgtttttcccgaaacccgttttccggtttaacgggttaccgggttttacccgggaacccggtaaaccggggtaacccgtaaaacgggggttaaacgtaaaacggttacgggtaaaaacccggttaaccgttagggttaccgggtaccttaccgggacctaacccgttaccgttaccgtttacccgg

SEQ ID NO: 146220 - DNA, 530 bp, Homo sapiens
  misc_feature: GYAE6OF02HAHV3.21.4.A04.1.454.CMB.1.raw
  modified_base (301)..(301): a, c, t, g, unknown or other
  misc_feature (301)..(301): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggggagacttggtccagcctggagggtccctgagactctcctgtgcagcctctgcattcaccttcagtgaccacaacatggactgggtccnccaggctccgagggagggctggagtgggtcggccgtattacgaaggaagctaacagttacagtacagaatacggcgcgtctgtagaaaggtaggttcacatctanaaganatagattacaaagactacactgtatctagacaaatgaacagcctagaaaccgagacgacgcgtagtattattaggtggtaagaacaaagngtaggagtggtaggtaggtagcgtgtacg

SEQ ID NO: 146221 - DNA, 535 bp, Homo sapiens
  misc_feature: GYAE6OF02HLNN8.21.4.A04.1.454.CMB.1.raw
  modified_base (199)..(199): a, c, t, g, unknown or other
  misc_feature (199)..(199): n is a, c, g, or t
  modified_base (350)..(350): a, c, t, g, unknown or other
  misc_feature (350)..(350): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctaactacatagcctggtaccagcagaagcctggccaggctcccaggttcctcatctatgctgggtcccacagggccactggcatcccagacaggttcagtggcagtgggtcngggacagacttcactctcatcattagcagactggagcctagaagtactttcgctaggttgttaatttacgtgtcagcctagttacgtggtaacgtttcaccgttcgttgttccgttcggaccgtagggacctaagggtaacgaaagtacgaaacgtacgtgtcggactcgccaccgtatcgtacg

SEQ ID NO: 146222 - DNA, 608 bp, Homo sapiens
  misc_feature: GYAE6OF02GOKHP.21.4.A04.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatatccagagctactanatagcctggtaccagcagaagcctggccaggctcccaggttccacatctatcgcgtcgggtcccagacgggccacgtgcactcccagacaggttcagtcggcaggtgggtctgggacagtacttcacttcctgactcattagcacgactggagtccgtagaagtagtttcgcgtagttgttaacttacgtgtacgacgtcgaagttagtagggtaacgttccaaccgttcgttcggttaccgttaccgggacccggtaaagggacccgtaaaggggtaaacgtaaagttaacggaaaaccggttaacggttacggtacgggtacccgttaggacccgtaaccgttacgttaccgtttaccgg

SEQ ID NO: 146223 - DNA, 571 bp, Homo sapiens
  misc_feature: GYAE6OF02GTVCG.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagagcagcttctcttcctcctgctactctggctcccaggctcagaaaccaccggagaaattgtgttgacgcagtctccaggcaccctgtctttgtctccaggggaaanagccacctctcctgcagctccagccagaatatccagagctactacatacgcctggtaccagcagaagcctggccaggctccaggttccncatctatcgctcgggtcccacgacgggccacgtggccagtcccagacaggttcagtggcaggtgggctgggacagtaccttcactctacatcattagctagacgtggacgacctagtaagtacttacgacgtagttgtattactgtacagtctaagttatacggtaacttccaccttcgtcgttcgttacggaccgtaacgggtacctaaggtaacggtaaacgttacggaaacgtacgttggtacggtaccgtacgtacctaaccgttagtaccgttaccg

SEQ ID NO: 146224 - DNA, 545 bp, Homo sapiens
  misc_feature: GYAE6OF02JN5WM.21.4.A04.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcaggggagagctgctcagttaggacccagagggaaccatggaaacccagacgcagcttctcttcctcctgctactctggctccaggctcagaaaccaccggagaaattgtagttgacgcagtctccaggcaccctgtctttgtctccaggggaaagngccaccctctcctgcagctccagccagaatatccagagctactacatacncctgtaccagcagagcctggccaggctcccaggttccncatctactgctgggtccccagagggcccatggcatcccagacaggttcagtgcgagtgggtctgggactaggacttnacgtctcaatcatatnaagactggacgaccgtgaacgatttacgcgtaagtggtattactgtacagcagtagtggaagtttacgacttctagttccgttcgaccgtaagggaacctaagggtaacggtaaatagtaaacggtaaaccgtggtaacggtcgtagaccgtacacgtctacg

SEQ ID NO: 146225 - DNA, 677 bp, Homo sapiens
  misc_feature: GYAE6OF02GE3GE.21.4.A04.1.454.CMB.1.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
  modified_base (293)..(293): a, c, t, g, unknown or other
  misc_feature (293)..(293): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctccagccagaatactccagagctactacatagcctggtaccagcagaacncctggccaggcctcccgaggttccncatctatcgctcgggtcccagcggccacgtggcactacccgagacgtaggttcaggtcggacgtagggttgggtcgtaggggaacacggtacctttcgactttctacagtctaagttacgacgtaacggtacgtagggactccgtaaggtaacgttacgtttaccggacgttaaggtttacgttaacgtttacgttacgtaccgtaagtacgtaaggtttaagttacgggttaaacgtttccctaaccgtttcgttcgggtttaccgggttaccgggaaccggtaacggggtaacccgttaaaagggtaaacgtaaacgttaacgggaaaaccgttaacgttaggtacggttcgtacgaccgtacccgttagttccgtttacgg

SEQ ID NO: 146226 - DNA, 650 bp, Homo sapiens
  misc_feature: GYAE6OF02JHJ0D.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaaangccacctctcctgcagctccagccagaatatccagagctactacatagcctggtaccagcagaagcctggccaggctcccaggtttccctaatctatgccgtggggtccccaacgtaggggcccacgtcgggccacttacccccaaggaactagggtttccaggttcgggacctagggttcggggtctaggggaaccaggtacctttcgaccttcgtcaatcgaatttacggacagacctgggaacgccgttagaaacgtatttcggactaggtagttaactttacctggttaccagtactaggttaacgttagggtaaacgtttccaacccttcgttacggttcggtttccggaccgtaaagggaccgtaaaggtacggaaaagttacggaaaacgttaaccgtggttaggaccgtacggtaccaacccggtactttaccggtcgttaccg

SEQ ID NO: 146227 - DNA, 749 bp, Homo sapiens
  misc_feature: GYAE6OF02FEQYL.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccacctctcctgcagcctccagcctaagaatactccagacgccttaacctacatacgccttggaaccagccaagaacgtccctgggcccagggcctccccgtaggttccctacattctagtcggcttcgggacccaaggcgggcccagtcgggaccaccgtacccgaagtaccgtaggtttcgaacggttcgggaccgttaaggggttcgggttaccgtacgggggaaacctaccgggttaaccttttacccgaacgtttacccgtacgtaaaccttaccgtttaaagtttacggaaccgtaacggtaaccggtttacgggaacgttacccgttaaaggtaaacgtacgttttaccggacgtaaggtttacgttaactttacgtcgttacgagtacgtaagttagtacggtacttccgtaccttcgttacggttccgttaccgggaccgtaacgggaaccgtaagggtaaacgtaaacggtaacgtaaaacccggttacgttacggtacggtaccgtacgtaccgtaaccgtacgttacgttaccgg

SEQ ID NO: 146228 - DNA, 509 bp, Homo sapiens
  misc_feature: GYAE6OF02HR7JL.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaantccaccctctcctgcagctccagccagaatatccagagctactacatagcctggtaccagcagaagcctggccaggctccaggttcccnatctatgctgggtcccacgngggccactggcatcccagaccaggttcagtggcaggtggtctgggacagacttcactctcatcattagcagactggacnctagaagtnttcgactagtgttattactgtcagtcagtataggtagttcacgttctcgtcgttcgacgtacggactaaggtagaacgtagaaacgacgtgtggactgacacctntacgtacg

SEQ ID NO: 146229 - DNA, 608 bp, Homo sapiens
  misc_feature: GYAE6OF02IDTIZ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccgccaggctccaggggaaggggctgggagtggggtcggccgtatacgaaggaaagctaacagttacagtacaagaatacggcgcgtctggtaggaaaggtaggttccaccatctacaaagagatagattacgaaaagtaacctacacttagtaatctagacaaaatcgaaacacgtacctaacggaaaaacccggaaggaaccgaccgggtacccgtagttaacgtttaagtttgggtaaggttaaacggaaagtaaaaacggtggttaagggtattggttaggggttgggtaaggttctgggtaaccgg

SEQ ID NO: 146230 - DNA, 573 bp, Homo sapiens
  misc_feature: GYAE6OF02JTA27.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccnatctatcgctcgggtccccagagggccacgtcggcacgtcccaggtaccaggtttccaggttcggacaggttgggtcctaggggaactacggactttccacgttctcatcagtttagctacgacgtggacgtcctagaagtattccgatagtgtaacttacgtgtacagtcgagtagtaggtagttcctacgttcgtgtaccgttcgacgaggtaccgtaaggtacgtaaactggaaaccgttacgtggtacgtccgtaggacctaaccgtagttaccgttacg

SEQ ID NO: 146231 - DNA, 608 bp, Homo sapiens
  misc_feature: GYAE6OF02GZO5G.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcgaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaangcccaccctctcctgcagctccagccaagaatactccagacgcctactacatacgcctggtaccagcaagaacgcctggcccaggcctcccgaggttccctcatctatcgcgtcgggtccccacgacgggccacgtggccactcccagaccaggttcaggtcggcaggtgggtctagggacagtacttcactctcatcattacgacagacgtggacgtccgtaggaagtactttcgacgtagttagttattacgtgtacagtactagtagtaggtaacgttcctaccgttcgttacggttcggttaccggaccgtaacgggtaaccgtaaagggtaacgtaaacgttaacggaaaccgtaacgttaggtacggtacgttacggacccgtaactacgttcgttacg

SEQ ID NO: 146232 - DNA, 519 bp, Homo sapiens
  misc_feature: GYAE6OF02JII6X.21.4.A04.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaancctggccaggctcccaggttcctnatctatgctgggtcccanagggccactggcatcccagacagttcagtggcagtggtctgggacagacttcactctcatcattagcagactggagcctgaagtatttcgactagtgtacttacgtgtaccagacagttagtggtaagttcacttctagtcgttcgaccgagggaccaaggtaacgaactaggaaacgtacgtagtacggactcgctaccgattcgtacg

SEQ ID NO: 146233 - DNA, 583 bp, Homo sapiens
  misc_feature: GYAE6OF02HRR49.21.4.A04.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccaganctactacatagcctggtaccagcagaagcctggccaggctcccgaggttccctcatctatgctcgggtcccacgngggccacgtggcactcccgagacgaggttcaggtggcaggtgggtctgggacaggacttcactctcatcattagcagacgtggagctgaagtatttcggactagtgttattacgtgtacagtctagtagtaggtaacgtttcaacccgtttgttcggttaccgttaccgggaccgtaacggggtaaccctaaaggggtaacgaaaagttacggaaaaccgttaacgttgggtacggtacttacggacccgtaactacgttccgttacgg

SEQ ID NO: 146234 - DNA, 576 bp, Homo sapiens
  misc_feature: GYAE6OF02G258A.21.4.A04.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagtcgtcgctcgcacgaccggtgctcgatttagagtagtgatcaggggagagctgctcagtttaggacccagagggaaacccatggaaaccccagcgcagcttctcttcctcctgctactctggctcccaggctcagaaaccacggagaaattgtgttgacgcagtctccaggcaccctgtctttgctccaggggaaanagcccacctntcctgcagctccagccagaatatccagagctaactcatacgcctggtaccagcagaagcctaggccaggctcccaggttcctcatctatgctgggtcccagagggccacgtggcactcccgagacctaggttccaggtggcaggtggtctgggacaggcttacacttcgtcatcattagctagacgtggagtccgtagaagtattcgctagtagttattacgtgtcagtcgtagttagtaggtaacgttcgtaaccttcgttacgttaccgttaccggaccgtaacgggtacctaaagggtaacggtaaacgttacggaaaaccgtaacgtaggtacggtaccgtcgaccgacctagtacgttcg

SEQ ID NO: 146235 - DNA, 608 bp, Homo sapiens
  misc_feature: GYAE6OF02IS6N3.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaangccaccctctcctgcagctccagccagaatactccagacgctactacatagcctggtaccagcagaagcctggcccaggctcccaggttcctcatctatcgcgtcgggtccccacgacgggcccacgtggccactcccagacctaggttcaggtggcaggtgggtctgggacaggtacttcacttctacatctagttagcagtacgtaggacgtccgtaggtaacgtacgtttacgacgtagttgttaacgtttacgtgtacgagtacgtaggttagtaggtaacgtttccgtaccgttcgttcggttaccggttaccgggaccgtaacgggtaccgtaaagggtaacgtaaagtacggtaaaccgtaacgttaggtacggtacgtacgaccgtacctacgtacgttacg

SEQ ID NO: 146236 - DNA, 529 bp, Homo sapiens
  misc_feature: GYAE6OF02GYTT0.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtccccacgagggccactggcatcccagacaggttcagtggcaggtggtctgggacagacttcactctcatcattagcagactggacgcctagaagtatttcgctagttgtattacgtgtcagcagttagtaggtaagttccaccttcgtggtcgttcggaccgtaagggaccaagggtaagaaacgttaggaaacgtacgtggtacggctgaccacgtatcgttcg

SEQ ID NO: 146237 - DNA, 642 bp, Homo sapiens
  misc_feature: GYAE6OF02JI4CN.21.4.A04.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggccaccctgtctttgctccgaggggaancgccaccctntcctgcagctccagccagaatatccagagcctaactacattacgccgttaggtacccagcaagaacgccctggccaggcctcccgaggttccacagttcctagtgccgttcggggtaccccagtacgggcccacggtggacctaactccccgaagacgtaggttcaacggttggacgtaaggttcgggtaccgtaggggaacctagtaccttcgactctacgatcgtagttagcgagtacgtaggcgtacctagaagtactttcggactagtacgttattacgttgaccgtagtcgtagttacgtagggtaacttccgaaccttcgttacggttcgttaccggaccgtaaggacggtaagggttaacgaagttaccggtaaacggtacgttacggtcggtaccgtcgtacgtaacccgttagttccgttacgg

SEQ ID NO: 146238 - DNA, 723 bp, Homo sapiens
  misc_feature: GYAE6OF02JBWUE.21.4.A04.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgaagtctccaggcaccctgtctttgtctccaggggaaangccacctctcctgcagctccagccagaatntccagagctaactacatagcctggtaccagcagaagcctggccaggctcccaggttcctcatctatcgctcgggtcccacgacgggcccacgttcgggcctaacgtccccgaaggactagggtttcaaggtcggcgaggttcggggtctcgggggactaggtacctttcgaaccttcgttcaagttcctaagttacgacaacggtacgtcgggaacgtcctaaggaaacgttacgttttcggactaggttacggttaatttaaccgttgttaacgacggtacgttaagggttaacgttacgggtaaacgtttccgtaacccgtttcgttacgggtttacccggtttaccgggaacccgttaaacgggggaacccgttaaagggttaaacggtaaacggttaaacgggtaaaaccggtaaacggttaccgggttaacgggtacgttaccgggtaacccgtaaccttaacggtttaccgttacggtttaacccgg

SEQ ID NO: 146239 - DNA, 539 bp, Homo sapiens
  misc_feature: GYAE6OF02HQAJT.21.4.A04.1.454.CMB.1.raw
  modified_base (290)..(290): a, c, t, g, unknown or other
  misc_feature (290)..(290): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttccncatctatgcgtcggtcccacgngggccacgtggcactcccagactaggttcaggtcggcaggtggtctgggactagacttcactctcatcattagcagctggactcgtagaagtntttcgctagttnttattctgtacagtctagttagtggtaagttcaccgttgttcgtcgttcggaccgtacgggtaactaagggtaagtaaacgtagaaacggtacgtggtacggctcgaccacctattcgtacg

SEQ ID NO: 146240 - DNA, 598 bp, Homo sapiens
  misc_feature: GYAE6OF02FQ6T4.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccacctctcctgcagcctccagccagaatatccagagctactacatagcctggtaccagcagaacgcctgggccagggcctccccgaggttccctcattctatgccttcgggtccccacgagggcccacgtcggcactcccagaccaggttcaggtggcaggtgggtctgggacagtacttcactctcatcattagcagactggacgtcctaggaagtagtttcgactagttagttaacttacgtgtccagtacgtaagttagtaggtaacgtttacctaccgttcttcggttacggttaccgggaccgtaacgggtaccgaaagggttaacgtaaagtaacgggtaaaaccgtaacgttaggtacggtcgtacggaccaaccgtagttcgttacg

SEQ ID NO: 146241 - DNA, 512 bp, Homo sapiens
  misc_feature: GYAE6OF02GEMW5.21.4.A04.1.454.CMB.1.raw
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactcncatcattagcagactggagcctgaagtatttcgctagtgtagttactgtcagtcagttatggtaagttcacctctcgtcgttcggaccagggaccaagggtacgaaagtacggaaacgtacgtaggtggactgacacctatctcg

SEQ ID NO: 146242 - DNA, 817 bp, Homo sapiens
  misc_feature: GYAE6OF02HOJXB.21.4.A04.1.454.CMB.1.raw
tcagtcgtcgctcgcacgaccggtgctcgatttagagtagtgatcaggggagcttcgtgagagcggagccccagccccaggaattcccaaggtgttttcatttggtgatcagcactgaacacagaggactcaccatggagtttgggctgagctgggttttccttgttgttattttacaaggtgtccagtgtgaggtgcagctggtggagtcctgggggagtacgttggtccgacgcctgggagggtccctgacgactctcctgtcgcaggcctctgcattccgaccttctagtgaccacaacatggactgggtccgccaaggcctcccgaaggggaacggggtctagggtacggttggggtacccggtaccggttaacttaaccggaaaacggtaaacggaccgttaaaaccgaggtttaaacctaaggtttaaccgaaggtaaaaccgttacccggggacgttccggttcgtacgggttaacggaaaacggggtaacgggtttacccaaaccccggtaagttaccgtacgtaaaaggtaaggtaacttacggtaagtttaacccgaaaaaggtaaaccgttcgaacgttaggtaaacttcttaacggtaactaaaacgttacgaaacgtaacgtacccgtaaacgggaaaaacccgtaggaaacccgaaccggggtaccgtttacggggttaacgttttacggtttacggggtaacggggtttaaacggaaaaccgtaaaaaagggtcggttaagggttaaccgttagggttaacggggtttagggtaaccgggttacgttacgggttaacccggg

SEQ ID NO: 146243 - DNA, 624 bp, Homo sapiens
  misc_feature: GYAE6OF02J21MB.21.4.A04.1.454.CMB.1.raw
  modified_base (214)..(214): a, c, t, g, unknown or other
  misc_feature (214)..(214): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtctggggganacttggtccagcctggagggtccctgagactctcctgtgcagcctctgcattcaccttcagtgaccacaacatggactgggtccgcaggcctccgaggggacgggctgggagtcgggtcggccgtagttacaaggaagctaaacgagttacagtaacagaatacgggcgtcgtcgtagtagaaagggaggtttccaaccgtattccgtacgaaaggacgtaattggaaatttacgaaaagttaaactcgaacttgtaacttcgtagtaccaaattgaaaccacgtacccgtaagaaaaacccggnggaaaccacgggtaccgttagttaacgtttagttaggtaacgggttaacaaacgtaaaacggtgtagggtaattgggtagggttggtaacggtcgtaggtaccgg

SEQ ID NO: 146244 - DNA, 548 bp, Homo sapiens
  misc_feature: GYAE6OF02G8D0Q.21.4.A04.1.454.CMB.1.raw
  modified_base (306)..(306): a, c, t, g, unknown or other
  misc_feature (306)..(306): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggggagacttgggtccagcctgggagggtcccctgagactctcctgtgcagcctctgcattcaccttcagtgacccacaacatggactggggtccnccaggcctccgagggagggctgggagtgggtcggccgtattacgaaaggaagctaaacagttacagtacagaatacggcgcgtctgtagaaaggaggttcaccatctacaagagatgattacaaagtaactcactgtatctgacaaatagaacagacctaagaaaacccgaggaccacggccgtagtattagtggtaggtaagaacaaaaggngtaggattggtaggtggtagtcgtgtacg

SEQ ID NO: 146245 - DNA, 725 bp, Homo sapiens
  misc_feature: GYAE6OF02IOAFK.21.4.A04.1.454.CMB.1.raw
  modified_base (201)..(201): a, c, t, g, unknown or other
  misc_feature (201)..(201): n is a, c, g, or t
  modified_base (710)..(710): a, c, t, g, unknown or other
  misc_feature (710)..(710): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggccaccctgtctttgtctaccaggggaaangccacctctcctgcagctccagccaagaaatatccaagacgctaactacatacgccgtaggtaaccagacaaggaacgtccgtaggcccaacggcctacccgaacgggtttccctacaacttcctaattcggccgttcgggtaccccaacggacggggtcccacgtgggcctaacgtccccgaaggaacctagggtttccaagggttcgggaccgtaagggtttcggggtacgtacgggggtaaccaacggttaccctttaccgaaccctttctacctaacggttaccctaagtttaaacggccccgtaaaggtaacgtcggggtaaacgcccgtaaggtaaacggtactttcggaactagtttacggtaatttacctgtacccgaagtccgtaaaggttacgtacggggtaactttaccgtaccgttacgttcgggtacccggtttaccgggaccgttaaagggaaccgtaaaaggtagtaaacgtacgaaacgtacgtgtagcgtanaccgtactatcttcg

SEQ ID NO: 146246 - DNA, 528 bp, Homo sapiens
  misc_feature: GYAE6OF02FJCGI.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccagagctactacatagcctggtaccagcagaagcctggccaggctccccaggttcctcatctatgctgggtcccacagggccacgtggcactcccagacaggttcaaagtggcagtgggtctgggacagacttcactctcatcattagctagactggagtcctagaagtatttcgcagttgtaattactgtcagcagtagtaggtaagttctacctcttcgtcgttcggaccgtagggaccaaggtaagaaagtacgaaaccgtaacgtagtaggtcgtgacaccatctacg

SEQ ID NO: 146247 - DNA, 572 bp, Homo sapiens
  misc_feature: GYAE6OF02GV0ML.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtccccagacgggccacgtggccactcccaagaccaggttcaggtggcaggtgggtctgggacagtacttcactctcatcattagcagacgtggacgtccgtagaacgtatttcgactagttgttaatttactgtacagactagttagtaggtaacgttcctaccttcgttggttccggttaccggaccgtaacgggtaaccgtaagggttaacgaaagttacggaaaaccgtacgttggtacggtacgtacgacctacctagttcgttcg

SEQ ID NO: 146248 - DNA, 516 bp, Homo sapiens
  misc_feature: GYAE6OF02H7WLM.21.4.A04.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccaggggaaangccacctctcctgcagctcagccagaatatccagagctactacatagcctggtaccagcagaagcctggccaggctccagttccncatctatgcttggtcccagacggccagtggcactcccagacaggttcagtggcaggtggtctgggacagacttcactctcatcattagcagactgganccgtagagtatttccgntagtgtattacngtacagcagtntggattccactctgtccgttcggactaagggacctaaggtagtaaagtcgaaaccgtaacgtggtcggactacggacctaacgtactgtacg

SEQ ID NO: 146249 - DNA, 679 bp, Homo sapiens
  misc_feature: GYAE6OF02JNMGP.21.4.A04.1.454.CMB.1.raw
  modified_base (145)..(145): a, c, t, g, unknown or other
  misc_feature (145)..(145): n is a, c, g, or t
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
tcagtcgtcgctcgcacgaccggtgctcgatttagagtagtgatcaggggagagctgctcagttaggacccagagggaaccatggaaaccccagcgcagcttctcttctcctgctactctggctcccaggctcagaaccacgganaaattgngttgacgcagtctccaggcacctgtctttgctccaggggaaacngccacctntcctgccagctccagccagatactccagacncgtaacacatacgcctggaccagcagaacgtcctggccaggcctccgaggttccctcgattccgtaacgtcgaccgtgggttaccccacgacgggccacggttggacctaacgtacccaaggaccgaacggtttccaacgggttcggacccgtaaggttcggggttcctagggggtaaccaacggtaccttttccgaaccgtttcacgaccgttacgtaacgttacgtaccgaacggtaccgttacgggacgtaccgttagtaacggttacgtttcgaccgttagtaacggttacttaaccgtcgtcgacgtaccgtacgttactaggggaaactttccgaaccttcgtcggttacgttacggacccgtaagggtacccaaggggttaaccaaagttccggaaaacgttaacgtgtacggtcgtacgacggacctgtaccgtcg

SEQ ID NO: 146250 - DNA, 545 bp, Homo sapiens
  misc_feature: GYAE6OF02FSVUA.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatcgctgggtcccacgagggccacgtggcatcccagacaggttcagtggcaggtggtctgggacagacttcactctcatcattagcagactggacgcctagaagtatttcgctagttgtattactgtactagctagttagtaggtaagttcaccttcgtcggttcgttccggaccgtaagggtaccgaagggtaagaaacgtaggaaaaccgtaacgttaggtacggtcgtacgacaccgtagtcgttacg

SEQ ID NO: 146251 - DNA, 718 bp, Homo sapiens
  misc_feature: GYAE6OF02GKGLT.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaanacgccaccctctcctgcagcctccagccaagaatactccagacgctaactacatacgcctaggtaccagacaaggaacgccgtgggcccaggccctacccgtaggtttccctactatcctagtcggtccgttcggggtaccccacgacgggccacgtggcctacgtcccgagactaggttcaggtggctagggtcgggtctacggggaactacgggtacttccgacttccgtactatacctaatttacggactaacggtacggtgggaacgtccgtaaggtaaacgtacgtttaccggacgtaaggttacgtttaacgttacgtcggtacgaggtacgtaaggttaacggttacgggtaaccgtttacctaccgtttacggttacggtttaccgggttaccgggtaacccggtaacggggtaacccgtaaaggggtaaacgtaaaacgttaaccgggtaaaaccggtacggttagggtacggtaccggttacgaccgtaaccgtacgttccgttacg

SEQ ID NO: 146252 - DNA, 599 bp, Homo sapiens
  misc_feature: GYAE6OF02JBO3R.21.4.A04.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccaganctactacatagcctggtaccagcagaagcctggcccaggcctcccaggttccncatctatgcctcgggtcccacgacgggccacgtggcatcccgagacaggttcaggtggcaggtgggtctgggacagtacttcactcnctatcattacgcagacgtggacgtccgtagaacgtagtttcgacgtagttacgtactttacgtcggtacaggtactagttagtacgggtaagttacctaccgttcttacggttccgttaccgggaccgtaacggggaacccgtaagggtaacggtaaaacgtacggtaaaaccgtaacgttacggtacggtacgtacggaccgaaccgtagtccgttacg

SEQ ID NO: 146253 - DNA, 548 bp, Homo sapiens
  misc_feature: GYAE6OF02IJTXT.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttcctcatctatgcctgggtcccacgacgggcccacgtggcacgtcccagacaggttcagtggcaggtgggtctgggacagtacttcactctcatcattagcagactggacgtcctagaagtatttcgctagtgttattactgtacgagctagttagtggtaagttcctaccgttcgttggttccgttcgggaccgaagggtacctaagggtaacgaaagtacggaaacgtacgtggtacgacgtcgacctacctatctcg

SEQ ID NO: 146254 - DNA, 665 bp, Homo sapiens
  misc_feature: GYAE6OF02JWV6D.21.4.A04.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaangccaccctctcctgcagctccagccagaatactccagagcctaactacatacgcctggtaaccagcagaacgccgtggccaggcctcccgaggttcccnacgtctagtcgtccgtcgggtacccagacgggcctacgtggaccactcccgagaccgtggttacgaggtcggactagggtagggtcgtagggaactaggtaccttcgacttcgtacatactaagttacgcgtaacgtacgtggacgtcgtaggaacgttacgttaccgacgttaggttacgttaacttacgtcgtacgtagtacgtaagttacggtacggtaacgttaccgttaaccgttcgtacggttaccgggttaccggaaccggtaacgggtaaccgtaaaggtaacggttaaacgtaacgggtaaaccgtaacggttcgggtacgtaccggttaccgaccgtaaccgtagttaccgttacgg

SEQ ID NO: 146255 - DNA, 695 bp, Homo sapiens
  misc_feature: GYAE6OF02HWG69.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaccccagcgcagcttctcttcctcctgctactctgactcccaggctcagaaccaccggagaaattgttgttgacgcagtctccaggccacctgtctttgtctccgaggggaangcctacctcgcctgcacgctcgagccagaatactccagacgtactactacatacgccgtaggtaccagtcaagaacgccgtggaccacggccttccccgaggtttccctacgactcctagtcgccgtcgggtaccccaggtacgggtccacgtgggcctaactcccgagtactacggttcaggtggactagggtcggttacgtggggaactagtaccttcgaccgtctacgtaagtacgtaagttacgaccgttaacggaccgttagggacgtaccgtaggaaagttactttcggaacgtaagtttacgttaacttacgtgtaccgaagtcgaagtttacgtaacggtaacgttccctaccgttacgtacggttaccggttacggaacccggtaacgggaacccgttaaagggtaaacgtaacgttaacggaaaaccggttacgttagggtacggtaccggttacggtaacggttaaccctagttaccgttaccgg

SEQ ID NO: 146256 - DNA, 567 bp, Homo sapiens
  misc_feature: GYAE6OF02FU0V2.21.4.A04.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaaangccaccctctcctgcagctccagccagaatatccagagctactacatagcctggtaccagcagaagcctggccaggctcccaggttccncatctatgctgggtcccagagggccacgtggcatcccagacaggttcagtcggcaggtgggtctgggacagacttcactctcatcattagcaagactggacgtcctagaacgtatttccgactagttgttaacttacgtgtcagtctagttagtaggtaacgtttctaccgttcttcggttcgttccgggaccgtaaggggtacccaaagggttaacgaaacgttacggaaaaccgtaacgtggttaggaccgtacggtacctaccgtacgtcgttacg

SEQ ID NO: 146257 - DNA, 591 bp, Homo sapiens
  misc_feature: GYAE6OF02J2YUT.21.4.A04.1.454.CMB.1.raw
  modified_base (201)..(201): a, c, t, g, unknown or other
  misc_feature (201)..(201): n is a, c, g, or t
  modified_base (430)..(430): a, c, t, g, unknown or other
  misc_feature (430)..(430): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatactccagagctactacatacgcctggtaccagcagaacgcctggccaggcctcccgaggttccctacatctatcgccgtcgggtccccacgacgggcccacgtcggccacgtcccagtaccaggttcagtcggctaggtcgggtctagggacagtacttcactctcatctattacgcacgacgtggactctagaagtnttcgctagttgtacttacgtgacagctaagtagtacggtacttcctaccgttcgtcggtccggttaccggaaccgtaacgggaccgtaaagggtaacgtaacgtacggtaaaaccgtacgttaggtcggtacgtacgtaccgtaacctagttaccgttacg

SEQ ID NO: 146258 - DNA, 591 bp, Homo sapiens
  misc_feature: GYAE6OF02HKZBM.21.4.A04.1.454.CMB.1.raw
  modified_base (199)..(199): a, c, t, g, unknown or other
  misc_feature (199)..(199): n is a, c, g, or t
  modified_base (266)..(266): a, c, t, g, unknown or other
  misc_feature (266)..(266): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaacncctggccaggcctcccaggttcccncatctatgcgtcgggtccccacgacgggcccagtcggcactcccagactaggttcagtcggcaggttcgggtctggggacagtacttcacttctcatacattacgacagacgtggacgtccgtagaacgtacgtttcgacgtagttagttacgttacttgtacagcgtaagtagtaggtacttaccgtaccgttcgttcgttaccggttacggtaccgtaacgggtaccgtaagggtaacgtaacggtaacggaaaccgtaacgtaggtacggtaccgtacgacgaacctagtccgtacg

SEQ ID NO: 146259 - DNA, 624 bp, Homo sapiens
  misc_feature: GYAE6OF02JDFS7.21.4.A04.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccacctctcctgcagctccagccagaatatccagagctactacatagcctggtaccagcagaagcctggccaggctccagttcctcatctatgctgggtcccacgagggccactggcatcccagacagttcagtgctagtgggtctgggacagacttcacttcnctatctatagcagactggagccgtagaagtatttcgactagttagttattacgtagtaccgtagtaccgtaagttagtaggtaacgtttaccgtaaccgttccgtacggttcccggtttaccgggtacccgtaaacggggtaacccgtaaacggggttaaaacggtaaaaccgttaaacgggtaaaaacccggtaacgtttacgggttacgggtaccgttaaccggtaacccgtaacccgtacgttacccgttaccgg

SEQ ID NO: 146260 - DNA, 579 bp, Homo sapiens
  misc_feature: GYAE6OF02GREKN.21.4.A04.1.454.CMB.1.raw
  modified_base (312)..(312): a, c, t, g, unknown or other
  misc_feature (312)..(312): n is a, c, g, or t
  modified_base (448)..(448): a, c, t, g, unknown or other
  misc_feature (448)..(448): n is a, c, g, or t
  modified_base (490)..(490): a, c, t, g, unknown or other
  misc_feature (490)..(490): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccaggccctgggacgggtccctgacgacctctcctgtgcagcctctgctattccaccttcagtgaccacaacatggactcgggtccnccgaggcctccgaggggagggctgggaggtgggtcggccgtatacgaaggaacgctaacgagttacagtacagaatacggcgtcgtctgtagaaagggtagtaccacatctagaagagatagaatacaaagtactnaactgtatctagactaaatcgaacacgacctaagaaaccggngaaccgacggtacgttagttattagttaggtaggtaacgaacgtaaaaggtggtaggtacttgggttagggtaggtaggtctggtaacg

SEQ ID NO: 146261 - DNA, 604 bp, Homo sapiens
  misc_feature: GYAE6OF02HUBVA.21.4.A04.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtcgtgggggagacttggtccagcctggacgggtccctgagacttctcctgtgcagcctntgcattcaccttnagtgaccacaacntggacgtgggtccgccagggcctaccggaaggggaaggggctgggaggtcggggtccggccgttataacgaaaggaagctaacagttaccagtacagaaagtacgggcgtcgtctggaggaaaggtaggttacaacctatactacgaagtaagatagtaacttaacaaaaggtaacctacacgttagtatctagactaaaatacgaacagaccgtaaggaaaacccgtcgggaacacgggtcgtagtagttacgtggtaacggtaagaacgaaaaggtcgtaggtagttggtgggttaggtacggtgttagtacg

SEQ ID NO: 146262 - DNA, 562 bp, Homo sapiens
  misc_feature: GYAE6OF02ITR44.21.4.A04.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
  modified_base (431)..(431): a, c, t, g, unknown or other
  misc_feature (431)..(431): n is a, c, g, or t
  modified_base (506)..(506): a, c, t, g, unknown or other
  misc_feature (506)..(506): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagacgctactacatagcctgtaccagcagaacgcctggcccgaggcctcccgaggttcccncatcctagtcggcctcgggtccccacgacgggccacgtggccacgtcccagactaggttccaggtcggctaggtcgggtctggggactagacttcacgtctacatctatacgcagactggacgctagtagattcgngtagtgttattactgtcagcgaagttagtgaagttccacttcgtgtcgtcggacgtacggaccgtaagggttaanaaacgtacggaaacgtaacgttggtacggccgttaggacctaaccgtgtactacgg

SEQ ID NO: 146263 - DNA, 544 bp, Homo sapiens
  misc_feature: GYAE6OF02FZI2S.21.4.A04.1.454.CMB.1.raw
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
  modified_base (469)..(469): a, c, t, g, unknown or other
  misc_feature (469)..(469): n is a, c, g, or t
  modified_base (503)..(503): a, c, t, g, unknown or other
  misc_feature (503)..(503): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctggtggagtctgggggagacttgggtccagcctgggagggtccctgagactctcctgtgcagcctctgcattcaccttcagtcgaccacaacatggactgggtccncaggctccgagggagggctgggagtgggtcgcgtatacgaaggaagctaacagttacagtacagaatacggcgcgtctgagaaaggtacgtcaccatctacaagngatgattacaaagtactcaacgtgtatctagactaaatgaaacagaccgtaagaaaacccgngaaccacggccgttagtacttagtggtaggtaanaacgaaaagtgtaggattggtaggtggtagtcgtggtacgg

SEQ ID NO: 146264 - DNA, 534 bp, Homo sapiens
  misc_feature: GYAE6OF02IQI15.21.4.A04.1.454.CMB.1.raw
  modified_base (355)..(355): a, c, t, g, unknown or other
  misc_feature (355)..(355): n is a, c, g, or t
  modified_base (465)..(465): a, c, t, g, unknown or other
  misc_feature (465)..(465): n is a, c, g, or t
  modified_base (505)..(505): a, c, t, g, unknown or other
  misc_feature (505)..(505): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccgccaggctccgaggggagggctgggagtgggtcggcgtatacaaggaagctaacngttacagtacagaatacggcgcgtctgtagaaaggtaggttcaccgatctacaagagatgattacaaagtactcactgtatctagacaaatgaacagacctagaaaccgngacacggcctagtacttagtggtaggtaagaacgtaaagngtaggagtggtggtaggtagcgtagtacg

SEQ ID NO: 146265 - DNA, 499 bp, Homo sapiens
  misc_feature: GYAE6OF02HCUTT.21.4.A04.1.454.CMB.1.raw
  modified_base (200)..(200): a, c, t, g, unknown or other
  misc_feature (200)..(200): n is a, c, g, or t
  modified_base (434)..(434): a, c, t, g, unknown or other
  misc_feature (434)..(434): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctaactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagattcgcagtgtattactgtcagcagtatgaagttcactntgtcgttcggccaagggaccaaggtaagaaatggaaaacgaacgtgtaggctagcaaccgatctg

SEQ ID NO: 146266 - DNA, 713 bp, Homo sapiens
  misc_feature: GYAE6OF02JIUAC.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagagctgctcagttaggacccagagggaaccatcggaaacccagcgcagcttctcttcctcctgctactctgctccagctcacgaaccaccgagaattgtgtgacgcagtctccacgccacctcgtcttcgtctacgagggaagacgaccaccctcctcctcgacgacgcctaccgacgacctaacgtaactaactaccgacgacgtacctaccgtaactactaacgtaccgtacggtaaccgaacgacgaacgaacnggacccgtacgggtaccgtaccggacggttacccctacggtaccgttacctacgtacgtacgttacggtaccgtacggtacccggaccgaacggtaccgaccgtacggtaccgaacgtacccgacggtacgtaacggtacgtacgtacggtacggtacgtacgggtacgtacggtacgtacgtacgtacgtacgtactacgtacgtacgtacgtaacgtacgtacgtacgtacggtacggtacgtacgtaacgtacgttacgtacgtacgtacgtacgtacgtacgtacgtacgtacgtagtagtacgtactactacgtcgtacgtacgtacgtacgacggtacgaacgtaacggtaacgtaacgtaacggtaacgtacggtacgtacgtacgtacgtacgtacg

SEQ ID NO: 146267 - DNA, 835 bp, Homo sapiens
  misc_feature: GYAE6OF02F5CJ4.21.4.A04.1.454.CMB.1.raw
tcagtcgtcgctcgcacgaccggtgctcgatttagagtagtgatctaggggtaggagactgctcagttaggacccagagggaaccatggaaacccacgcgcagcttctcttcctcctcgctactctggctcccacggctcacgaaccgacggaagtaattgtgtcgacgctacgtcctccgacggcctacccgttgttctttcgtccgtaccggaggggaagacgcccaccctcctcctgcacgcctaccgacggccgtaagtaacgttaacgtaccgtaaggtacgtaccgttaacctaaccaacgttaaccggcccgttacggtaacccgacggtacccgaaacgggaaccgttccccgttacgggacccctaacggggttcccttaccccggtaagggttttcccctactaaccgttaccggttaaggtccgtaccggttccgggggtacccccctaacccgggacggggtacccttacggtcggaccgtaccgtacccgtaagggtaccgttacgggttacacggggttacggtaccgtagggtttcgggtacgtacggggaacctacgtacccttacgaccgtttacctacgtacgttacgtaagttacgtacgtacggttacgtggaccgtacgttacggaacgttcgttccggacgttaggttacgttaaccttacgttacgtacgggacggtaacgtagggttacgtacggtaacgttccgacgttcgtacggttcgtaccggaccgtaacggacgtaacggtaacggtaacgttaccggtaaaccgtaggttccgtcggacttacgaccgtacctagtccgttacg

SEQ ID NO: 146268 - DNA, 526 bp, Homo sapiens
  misc_feature: GYAE6OF02G0X8G.21.4.A04.1.454.CMB.1.raw
  modified_base (197)..(197): a, c, t, g, unknown or other
  misc_feature (197)..(197): n is a, c, g, or t
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccaggggaangccacctctcctgcagctccagccagaatatccagagctactacatagcctggtaccagcagaagcctggccaggctcccaggttcctcatctatgctcgggtcccacgacgggccacgtggcactcccgagacaggttcagtggcagtgggtctgggacagacttcactctcatcattagcagactggancgtgaagtatttcgntagtgtattactgtcagctagtagtagaagttcacttcgtcgtcgttcggacgtaacgggactaaggtagtaaagtacggaaacgtaacgtaggtacggacgtagacctactacgtcgttacg

SEQ ID NO: 146269 - DNA, 532 bp, Homo sapiens
  misc_feature: GYAE6OF02GAWZP.21.4.A04.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaagcctggccaggcctcccaggttcctnatctatgctcgggtccccagacgggccacgtggcactcccagaccaggttcaggtcggctaggtgggtctgggacagtacttcactctcatcattagcagactggacgccgtagaagtatttcgctagttgtattactgtacagctagtagtggtaagttcacttctgtcgttacgaccgagggactaaggtaagaaatacggaaacgtacgtaggtacggcgtagacacgtatcgtacg

SEQ ID NO: 146270 - DNA, 577 bp, Homo sapiens
  misc_feature: GYAE6OF02GGCD5.21.4.A04.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccacctctcctgcagctccagccagaatactccagagctactacatagcctggtaccagcagaagcctggccaggcctcccaggttccncatctatcgcgtcgggtcccacgacgggccacgtggccacgtcccagactaggttccaggtcggcaggttgggtacgtggggacagtacttcactctcatcagttagcagacgtggacgccgtagaacgtagtttcggactagttagtaacttcgtgtctagctaggtagtaggtaacgtttcaccgttctacggttccgttccggaccgtaacgggaccgtaaagggtaacgaaagtaacggaaacgtaacgttggacggtacgtacgaccacctagttacttacg

SEQ ID NO: 146271 - DNA, 551 bp, Homo sapiens
  misc_feature: GYAE6OF02G0TG5.21.4.A04.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
  modified_base (408)..(408): a, c, t, g, unknown or other
  misc_feature (408)..(408): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcaagaagcctggccaggctcccgaggttcccncatctatgctgggccccagcgggccacgtggcatcccagacaggttcagtggcaggtggtcngggacagtaccttcactctcatcaattacgcagacgtggactaccgtggaaagtntttacgctagttacgtattactgtacagtcgtagtagtgtaacttcaccgttcgtcgttccgttacgaccgtaacgggacctaaggtaacgtaagtaaggaaccgtaacgtagtcggtacgtagaccgtaccgtactacgtcg

SEQ ID NO: 146272 - DNA, 569 bp, Homo sapiens
  misc_feature: GYAE6OF02F7GY7.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaagcctggccaggcctcccaggttcctcatctatgccgtcgggtccccagacgggccacgtggccactcccagacaggttcagtcggctaggtgggtctgggacagtacttcacttctcatcattagcagtactggacgccgtaggaacgtactttcgacgtagttcgttaacttactgtacagtctagttatagggtaacgttctaccttcgtcggttccgttacggaccgtaacgggaccgtaaagggtaacgtaaagtacggaaacgtaacgtaggtacggtactacggacaccgtatcgtacg

SEQ ID NO: 146273 - DNA, 487 bp, Homo sapiens
  misc_feature: GYAE6OF02HXNGI.21.4.A04.1.454.CMB.1.raw
  modified_base (210)..(210): a, c, t, g, unknown or other
  misc_feature (210)..(210): n is a, c, g, or t
  modified_base (438)..(438): a, c, t, g, unknown or other
  misc_feature (438)..(438): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctntcctgcagctccagccagaatatccagagctactacatagcctggtaccagcagaagcctggccaggcctcccaggttcctcatctatgctgggtcccacgagggccactggcatcccagacaggttcagtggcaggtggtctgggacagcttcactctcatcattagcagactggacgctagaacgtatttcgctagtgtattactgtcagcagtatgtagtcactntgtcgtcgcaggacaaggtagaatagaacgagtgtggctgcacatctcg

SEQ ID NO: 146274 - DNA, 566 bp, Homo sapiens
  misc_feature: GYAE6OF02IWQ14.21.4.A04.1.454.CMB.1.raw
  modified_base (194)..(194): a, c, t, g, unknown or other
  misc_feature (194)..(194): n is a, c, g, or t
  modified_base (379)..(379): a, c, t, g, unknown or other
  misc_feature (379)..(379): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggaccaggctcccagtctcctcatctatggggcatcctacaggatgaccggcatcccagacaggttcagtgccagtggtctgggacaggacttcactctacaccatcaacacactggcncctagaagtattttgactagttagttacttacgtgttacgagtagttgttattgggtaggtccgtaaccgtactaccgtttcggaccgaaggggaccgtaaggtggagtacgtacgacggacgtaacgtgggtaggtcctaggacctaccgtacgttcgtacgttcttaccacttccgtcccgtacc

SEQ ID NO: 146275 - DNA, 617 bp, Homo sapiens
  misc_feature: GYAE6OF02I718G.21.4.A04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagccaccctctcctgcagcctccagccagaatactccagagctactacatagcctggtaccagcagaacgcctggccaggcctcccaggttcctcatctaatcgcgtcgggtacccacgacgggccacgtcggacactcccagaccnggttccaggtcggacgaggtcgggtctgggacagtacttcacttcacatcattacgcacgacgtggacgactagaacgtattacggactagttagttacttacgtgtacagtacgtagtacgtagggtaacttaccgtaaccgttcgttacggttccggttaccggtaccggtaacgggtaaccgtaaagggttaacgtaaacgtaacgggtaaaccggtaacgttaggttacggtacgttaccgaccgtaacctacgttagttaccgg

SEQ ID NO: 146276 - DNA, 573 bp, Homo sapiens
  misc_feature: GYAE6OF02G0LJU.21.4.A04.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccagggaaangccacctntcctgcagctccagccagaatatccagacgctaactacatagcctggtaccagcagaagcctggccaggcctccaggttcctcatctatgaccgtcgggtcccacgacgggccacgtcggcactccagacaggttcagtgcaggtggtctgggacagacttcactcncacatcacagactgacgcgtagaagtacgtttgacgtagtagtattacgtgtacacgtacgtagttagtaggtaacgttcaccgttcttcggttccgttacggaccgtaacgggtacgtaacgggtaacgtaaacggtaacgaaacggtaacgttacggtacgtacgtacggtacccgtaacgtacgttacgtcgttaccg

SEQ ID NO: 146277 - DNA, 830 bp, Homo sapiens
  misc_feature: GYAE6OF02HSBNM.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttccttgttgttattttacaaggtgtccagtgtgaggtgcagctggtggagtcgtgggggagacgttggtccagcccgtgggacgggtccctggacgactctcctgtgcagcctctgctacttccaccttcagtcgacccaacaacatcggactcggggtcccgccgacgggcctacccggaagggggaacgggggtccgtaggggtacgggttcgggggttacccggggtacccggttaacgtttaaaccggaaaacgggaaacggtaaccgttaaaaaccggtaacggtttaaaccgaaacggttaaaccgtaaagggtaaaaccggtaacccggggtacccggttaccggtttacgttacggggtaacgggtaaaaacgggggtaacgggtttaacccgaacccgtaacgtttacccgtaacgaaaacggaagtaaacgttaggtaacgtttaaacgaaaacgtaaaccttaaccgtaacgtttagtaacttcgtaacgtaacgtaaagtaacgaaaccgtacgaaccgtaacggaaaaccgtacggaaaccgaccgggttaccgtagtttacgtttaacggttaggtaacggtaaacggaaacgtaaaaagggtcggttaagggttaacgttagggttacgggttaagggttacggtccgttaggttacccgg

SEQ ID NO: 146278 - DNA, 784 bp, Homo sapiens
  misc_feature: GYAE6OF02JRZVO.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (234)..(234): a, c, t, g, unknown or other
  misc_feature (234)..(234): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttgtctccgaggggaaangccaccctntcctgcagtctccagccaagaatanccagacgtctaactacataggcctggtaccagcaagaacgcctggcccaggtcctacccgaggtttcccacgtatcctagtcgcgttcgggtaccccagacggtccgaacttcggactaacgtcccaaggacctacgggtttanacgggttgggacctagggtttccggggacttaggggaaccngggtaaccctttcggtaaactccgtttacgacttcgtaaacgttacgtaccgtaacggtacgttaacgggaccgtaccgttaggtaaaacggtccgttttaccggaacgttacggttacggttttaacgttaacccgttggtaccgttaaccggacgtttaaccgggtaaggtttaaacgggtaacggttttaccctaaccggtttccgtttacgggtttaccgttaccggggtaacccgtaaacgggggttaacccgtaaacggggtaaacggttaaacggttaccggtaaaaacccggttagggtttacgggtacggttaacggtccgttaacccgggaacctttaccgttaaccggtttcgg

SEQ ID NO: 146279 - DNA, 636 bp, Homo sapiens
  misc_feature: GYAE6OF02GI41H.21.4.A04.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagcctccagccagaatatccagagctaactacatagcctaggtaccagcagaagcctggccaggcctacccgaggttcccntactcttatcgcgtcgggtccccagacgggccacgtcggctactcccgagacaggttcagtcggcaggtcgggtctgggacagtacttcactctcatcatagcagtactggacgtcctaggaacgtacgtttcgacgtagttcgttaactttaccgtgtccgaaggtactaaggttagttgggtaacgttaccgtaaccgttcgttaccggttccggttaccggaacccggtaacggggtaacccgtaaaggggttaaggtaaaacgttaaccgggaaaaccgttaacgtttagggtacggtacgtaccggacccgtaaccgttacgttccgttacg

SEQ ID NO: 146280 - DNA, 600 bp, Homo sapiens
  misc_feature: GYAE6OF02G6CGL.21.4.A04.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcctcatctatgcctgggtcccacgngggcccacgtcggcatcccagacaggttcaggtcggcaggtgggtctgggacagtaccttcactctcatcattagcagactggatcctaggtaagtactttcgcgtagttcgttattacgtgtacgngtactagttagtagggtaacgttccaaccgttcgttacggttccgttaccgggtacccgaacggggtacccgtaaagggtaacggtaaaacgtaacggtaaaaccggtaacgttacggttcgggtacgttacggtaccgtaaccgtacgttaccgttacgg

SEQ ID NO: 146281 - DNA, 591 bp, Homo sapiens
  misc_feature: GYAE6OF02IPHF8.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatactccaggacgctactacatacgccttaggtaccagcaaggaacgcctggccaggcctacccgaggttcccacattctatcggccgttcgggtccccaggacgggccacgtggccactcccaagacctaggttcaggtggctaggtcgggtctgggacagtaccttcacttctcatctatacgcagacgtaggacgtcctagaacgtacttcgactagtagttacttacgtgtctagctaagtacgtaggtaacttctaccttgtcgttaccgttcgggaccgtaagggtaccgtaagggtaacgtaaacgtaacggaaacgtaacgttggtacgtctacggactacctagtcttacg

SEQ ID NO: 146282 - DNA, 585 bp, Homo sapiens
  misc_feature: GYAE6OF02HZBA3.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctcctgcagctccagccagaatatccagagctactacatagcctggtaccagcagaacgcctggccaggcctcccgaggttcctcatctatcgcgtcgggtccccacgacgggccacgtcggcactcccagactaggttcaggtcggctaggtgggtcgtgggactagtacttcactctcatactagttagctagacgtggacgcctagaacgtatttcgacgtagttacgttattacgtgtacagtcgtaagttagtaggtaacgttcaccttcgtcggttccgttaccggaccgtaacgggaccgtaaagggtaacgtaaacgtacggaaacgtaacgtaggtcggtacgtcgaacctactacgtcgttacg

SEQ ID NO: 146283 - DNA, 721 bp, Homo sapiens
  misc_feature: GYAE6OF02JBGT0.21.4.A04.1.454.CMB.1.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagcgtggtggaggtcgtggggggagtacgttgggtccaggtcccgtggggagggtccccgtggaggtacctcctccgtgtcgccagcctctgctattccacccttnacgtcgaaccacaacagtcggacgtcgggtcccnccgaggcctaccgagggaaggggcgtgggaggtcggggtccggaccgtagttaacgaaaggaacgctaacgagttacaagtaacgagaaacgtacggacgcggttactacggtaaggaaagggtaacggttaccaaccgtactactaacgaaacgtaagtagtagtaacgttaacgtaaaacgtaacctacgtaacgttacgttaacttacgtacgaactaaagtacggtaaacaccgtaacccgtaacggtaaaaacccggaaggaaccgtaaccgggtacggttaacgttacgttacggttacggttaagggtaaacggtaaacgtaaaaaggtacggttaaggaaggtttgggttacgggtgggtaacggttcgttaagggtacg

SEQ ID NO: 146284 - DNA, 552 bp, Homo sapiens
  misc_feature: GYAE6OF02IDYDF.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtacagcagaagcctggccaggctcccaggttccnatctatgctgggtcccagacgggccacgtggacactcccagacaggttcagtggcagtgggtctgggacagtacttcatctnatcattagcagacgtggacgcctagaagtatttcgactagttgttattactagtcagtctaagtagtaggtacgttacaccgttcgtagttccgttcggaccgtaacgggaaccgtaagggtaacgtaaaagtcggaaaaccgttaacgtgtacggacgtagaccacctacgttcttacgg

SEQ ID NO: 146285 - DNA, 630 bp, Homo sapiens
  misc_feature: GYAE6OF02GQ3L0.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggagggtccctgagactctcctgtgcagcctctgcattccaccttcagtgaccacaacagtggactgggtcccgccgaggcctccgaggggaacggggctgggaggtgggtccggccgtaagttacgaaggaagctaaacgagttacagtacagaactacggcgcgtctagtagaaagggtacgttacacctatctacgaagagatgaattacaaagtactcaacttgtactctgaactaaagtcgaaacgacgtacccgtaaggaaaaacccggagggaacccgtaccgggtaccgttagttaacgtttaggtttggtaacgggttaaggaaacgtaaaaagggtaggtacgggtagtttcgggttaggggttacgggtaagtccggttaggtaaccg

SEQ ID NO: 146286 - DNA, 580 bp, Homo sapiens
  misc_feature: GYAE6OF02JCNNY.21.4.A04.1.454.CMB.1.raw
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattccaccttcagtgaccacaacatggactgggtccgccaggctccgagggaggggctggaggtcgggtcggcgtattacgaaggaagctaacagttacagtacagaacgtacggcgcgtctgtagaaaggagttcaccatctnaagagatagatacgaaatactcattgtatcanacaaatacgaacagaccgtaagaaaaccggaggaacctaccgggacgttagttactttagttagggtacggttaagaaacgtaaaaggtacggtagggtagttcggggttagggtagggttacgtaccgtggtaaccgg

SEQ ID NO: 146287 - DNA, 507 bp, Homo sapiens
  misc_feature: GYAE6OF02IKOMF.21.4.A04.1.454.CMB.1.raw
  modified_base (311)..(311): a, c, t, g, unknown or other
  misc_feature (311)..(311): n is a, c, g, or t
  modified_base (409)..(409): a, c, t, g, unknown or other
  misc_feature (409)..(409): n is a, c, g, or t
  modified_base (427)..(427): a, c, t, g, unknown or other
  misc_feature (427)..(427): n is a, c, g, or t
  modified_base (491)..(491): a, c, t, g, unknown or other
  misc_feature (491)..(491): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggcccaggctcccaggttcctcatctatgctgggtcccacngggccactggcatcccagacaggttcaggtggcaggtgggtctgggacagacttcgactctcatcattacgcagagtggacgcgtagtaagtcgtcgntagttgtattacgtgtanacgatagtgtagtactctactgtcgtcgtcgacgaggacgtaggaataagacgaactagtgcgngtcgacactatctacg

SEQ ID NO: 146288 - DNA, 650 bp, Homo sapiens
  misc_feature: GYAE6OF02GXTOG.21.4.A04.1.454.CMB.1.raw
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagcccaccctctcctgcagctccagccagaatactccagagctactacatagcctggtaccagcagaacgcctggccaggcctcccgaggttccctnacttctatgccttcggggtaccccacgacggggcccacgttcgggcctacgtaccccgagtaccgaaggtttccaaggttcgggccagggttgggtctaggggactaggtaccttcacttcctacatctattacgctagtactgggactccgtagaagtctttcgactaggttagttacttacgtgtacgagtactaggttagtaggtaacgtttcgtaaccgttcgttacggttccggttaccgggtacccgtaaacggggtacccgtaaagggtaacgtaaagttaacgggaaaaccggttaacgttaggttacggtacgttaccgaccgtaaccgtagttaccgttaccg

SEQ ID NO: 146289 - DNA, 622 bp, Homo sapiens
  misc_feature: GYAE6OF02ILJE1.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctntcctgcagctccagccagaatactccagacgctactacatacgcctaggtaccagacagaacgcctcggaccaggcctacccgaggttccacattctatcgcgtcgggtacccacgacgggccacgtggacctactcccgaaggaccgtaggttcaaggttcggacgtagggttcgggtcgagggaactacggtacttacacgttctacatactaattacgcaacgtacgtggacgtaccgtagtaacgtagtttacgacgttagttagttacttacgtgtacgagtacgtaggttagtacggtaacgttacaccttcgtcggttccggtacgaccggaacggtaaccgtaagggtaacgaaacgtacggaaacgtacgttaggtcggacgtacgacctaactacgtcgtacg

SEQ ID NO: 146290 - DNA, 676 bp, Homo sapiens
  misc_feature: GYAE6OF02GWCO1.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaggtgtcagtgtgaggtgcagctggtggagtcgtgggggagacttggtccacgccgtggacgggtccctggacgtactctcctgtgcacgcctctcgctattccaccttcgagtcgaaccaacaacagtcggactcggggtcccaccgacggtccgtaccggaggggaacggggcgtagggaggtcggggtacggaccgttaagtacgaaaggtaacgtaccgtaaacgtagttaacaacggtaacaacggtaacgtaccgggcgtacggttcgtaggtaacggtaaagggtacggtttaccaacgtactactacgaaacgtagtaatagtaacttaacgaaagtaacctactaagttagtaacttctagaactaaagtcggaaccaacggacctaaacgggaaaccgaaccggtacgaccggtacgtagttacgttagttacgggagtaagaaacgtaaaggaggttaggagtcgggttaggtacggtagtccggtagtacg

SEQ ID NO: 146291 - DNA, 517 bp, Homo sapiens
  misc_feature: GYAE6OF02JH9MQ.21.4.A04.1.454.CMB.1.raw
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
  modified_base (456)..(456): a, c, t, g, unknown or other
  misc_feature (456)..(456): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctggagggtccctgagactctcctgtgcagcctctgcattcaccttcagtgaccacaacatggactgggtccgccaggctccagggagggctggagtgggtcggcgtattacaaggaagctaacngttacagtacagaatacggcncgtctgtgaaaggaggttcaccatctcaagagatgattacaaagactcactgtatctgacaaatgaacngacctagaaaccgnggaccacggccgtatacttagtgtaggtaganaaagngtagatgtggtagtagtctgtacg

SEQ ID NO: 146292 - DNA, 679 bp, Homo sapiens
  misc_feature: GYAE6OF02GW397.21.4.A04.1.454.CMB.1.raw
  modified_base (201)..(201): a, c, t, g, unknown or other
  misc_feature (201)..(201): n is a, c, g, or t
  modified_base (394)..(394): a, c, t, g, unknown or other
  misc_feature (394)..(394): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagctccagccagaatctccagagctacacatacgcctggtaaccagcaaggaacgcctggacccaggcctcccgaggttccctacatctatcgcgtcgggtcccagacgggccacgtggaccactcccgagacgtaggttcaggtcgcgaggtgggctgggacagtactcactctanatactagttacgctaagacgtggagtaccgtagtaacgtagtttcggactaggttacttaacgtttacgttcggtactacgtacgtaaggttacgttacgggttaactttaccgaaccgttttccggttacgggtttaccgggttacccgggaaccggttaaaccgggggtaacccgtaaaaggggtttaaaccgaaaacggttaaccgggtaaaaaccggttaaccggttaggttaacgggtaccgttaccggtaacctaacccggttacgttcgtttacccgg

SEQ ID NO: 146293 - DNA, 715 bp, Homo sapiens
  misc_feature: GYAE6OF02IGEU6.21.4.A04.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctcgaaggggaancgccacctctcctgcagcctcagccagaatacnccagagctactacatacgcctaggtaccagacaaggtaacgccgtggaccacggcctcccgaggtcctccgtacacttcgtagtcggtcgaccacgtccgaggacgacgggcctaacgtggaccacgtcccgaggaaccgtaggttacagggtcggacgtaggtcggggtactacggggactaacggtactttccgaccgttaccgtacctaaccgtactacctaaccgaacgtaccgtacggacgtaccgtaggtaaacgttacgttttacggacgttacggttacgttaacgtttacgtaggttaccgtaagtaccgtaagttacggttacggttacgtaccttacctacccgttaccgtacgttacgttaaccgtttaccgttttacgggtaccggtaacggggtaaccggttaaacgggttaacggtaaacgttaaccggtaaaaccggttaaccggttacggtacggtaccgtaccgg

SEQ ID NO: 146294 - DNA, 625 bp, Homo sapiens
  misc_feature: GYAE6OF02JVUMC.21.4.A04.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanagccaccctctcctgcagcctccagccagaatactccagacgtctactacatacgcctggaccagcagacgcctggccaggcctaccgtaggttcccnatctatcgcgtcggtacccagacgggccagtcggcactcccagacgagttcaggtggactaggtggtcnggacagtacttcactctcatctagttacgcgtacgacgtggacgtaccgtaggtaacgtactttaccggacgttagttacgttaacttacgtacgtaccgtagtaccgtaagttacggtacggttaaaccgttccgtaccgttcggttacggttaccggtttcggaaccggtacgggtaacgtaagggtaaacgtaaagttacggtaaaccgttagttcggtacggtacgtaccgtaccgtacgtacgttccgttacg

SEQ ID NO: 146295 - DNA, 542 bp, Homo sapiens
  misc_feature: GYAE6OF02GJJSC.21.4.A04.1.454.CMB.1.raw
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
  modified_base (465)..(465): a, c, t, g, unknown or other
  misc_feature (465)..(465): n is a, c, g, or t
  modified_base (511)..(511): a, c, t, g, unknown or other
  misc_feature (511)..(511): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccncaggctccgagggagggctggagtgggtcgccgtatacgaaggaanctaacagttacagtacagaatacggcgcgtctgtagaaaggtaggttcaccatctacaagagatgattacaaagtactcactgtatctagacaaatgaacagacctaaggaaaacccgnggaaccacggtccgtagttattattggtaggtaagaacgaaaaggngtaggatggtaggtaggtagtcgtaggtacg

SEQ ID NO: 146296 - DNA, 558 bp, Homo sapiens
  misc_feature: GYAE6OF02IKM7B.21.4.A04.1.454.CMB.1.raw
  modified_base (398)..(398): a, c, t, g, unknown or other
  misc_feature (398)..(398): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagcctggacgggtccctgagactctctgtgcagcctctgctattccacctttcagtgaccacaacatggactggggtccgccaggctccgagggaacggggctgggaggtcggggtcggccgttataacgaaggaaacgctaaacgagttacaagtacagaagtcggacgngtctggtagaaaggtagttcacatctacgaagagatagattacaaagactacactgtatcagacaaatagaacacgactagaaaccgagacacggcgtagtattagttgtaggtaagaacgtaaagacgtaggagtggttggtaggtacgcgtaggtacg

SEQ ID NO: 146297 - DNA, 600 bp, Homo sapiens
  misc_feature: GYAE6OF02GBAIF.21.4.A04.1.454.CMB.1.raw
  modified_base (201)..(201): a, c, t, g, unknown or other
  misc_feature (201)..(201): n is a, c, g, or t
  modified_base (365)..(365): a, c, t, g, unknown or other
  misc_feature (365)..(365): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatatccagagctactacatacgcctggtaccagcagaacgcctggccaggcctcccgaggttccctcactctatcggcgtcgggtcccaacgcgggccacgtggcactcccagactggttcagtgcaggtggtcngggacagtcttcactcnctatcatagcagacgtggacgtacctaggaacgtatttcgactagttagttaacttacgtgtacagtctagttagtaggtaacgttcgtaccgttcgttacggttcgttccggaaccgtaacgggtaaccgtaagggttaaacgaaacggttaacggtaaaaccggtaacgttaggtacggtaccgttacgacccgtaaccgtacgttacgttaccgg

SEQ ID NO: 146298 - DNA, 618 bp, Homo sapiens
  misc_feature: GYAE6OF02FR9JD.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccaagaatactccagagctaactacatacgcctggtaccagcaagaacgcctggccaggcctccccgaggttccctacattcctagtcgaccgttcggggtccccacgacgggccacgtggcactcccagactaggttcagtcggcaggtcgggtctgggacaggtacttcgacttcacatctattacgactagtacgtggacgtccgtagaacgtattcgactaggttacgttattacgttcgtacgacgtacgtaaggttagtaggtaacgttacctaccgttcgttcgttcggttaccggaccgtaacgggaccgtaaagggtaacgaaacgttacggtaaaaccgtaacgttaggtacggtcgttacgacctaccgtacgttacgtacg

SEQ ID NO: 146299 - DNA, 516 bp, Homo sapiens
  misc_feature: GYAE6OF02FOBZ4.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtaccagcagaagcctggccaggctcccaggttccnatctatcgctgggtcccagagggccactggcatcccagacaggttcaggtggcaggtggtctgggacagacttcactctcatcatagcagacgtggagtctagagtatttcgagtagtgtattactgtacagtcagttagtaggtaagttcacgttcgtgttcgtcgaccgtagggaccaagggtaagaagtacggaaacgagtggtagctcgactactatctacg

SEQ ID NO: 146300 - DNA, 647 bp, Homo sapiens
  misc_feature: GYAE6OF02HJIVS.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngcccaccctctcctgcagctccagccaagaatactccagacgacttactacatacgcctaggtaccagcagaacgcctggaccaggcctcccgaggttcctcatctatcgcgtcgggtaccccacgacggggccacgtcggccacgtcccgaagaccgtacggttcgagtggacgtagggttcgggtacgtcggggaactagtaccttcgtaccttctacgtaactcgtaactttaggacaggtacgtcgggacgtaccgtagtaacgtacgtttacgacgttagttacgttattacgtgtactagcgtaagtagtacggtaacgttctaccgttgttacggtaccggttacgggaccgtaacgggaccgtaaggtaacggtaaacgtaacggtaaaaccgtacggttaggtacggaccgtacgtaccgaaccttagtccttacg

SEQ ID NO: 146301 - DNA, 559 bp, Homo sapiens
  misc_feature: GYAE6OF02ISI6U.21.4.A04.1.454.CMB.1.raw
  modified_base (218)..(218): a, c, t, g, unknown or other
  misc_feature (218)..(218): n is a, c, g, or t
  modified_base (472)..(472): a, c, t, g, unknown or other
  misc_feature (472)..(472): n is a, c, g, or t
  modified_base (519)..(519): a, c, t, g, unknown or other
  misc_feature (519)..(519): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggganacttggtccagcctggagggtccctgagactctcctgtgcagcctctgcattccaccttcagtgaccacaacatggactggggtccgccaggcctccgagggaagggctgggagtgggtcggcgtatacaaggaagctaacagttacagtacagaatacggcgcgtctggtagaaaggaggttcaaccatctacaagagatgattacaaagactcaactgtatctagacaaatgaaacagacctagaaaaccgnggaaccacggcgtagtattagttcggtaggtaacgaacgtaaaaggngttagggattgggtagggtgggtaacgcgttaggtaacgg

SEQ ID NO: 146302 - DNA, 566 bp, Homo sapiens
  misc_feature: GYAE6OF02HZTER.21.4.A04.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccacctctcctgcagctccagccagaatatccagagctactacatagcctggtaccagcagaagcctggccaggctccagtttccncatctatgctcggtcccagacgggccacgtggcatcccagtacaggttcaggtggctaggtcgggtctggggactaggtactttcacgttctacattcaagtttacgctaagtacgtggacgtccgtaggaagtatttcgacgtagttgttacttacgtgtcagctaggttagtaggtaattccaccttcgtcgtccgttcggaccgtaagggtacctaagggtaacgaacgtacggaaacgtacgtggtacggactaggaccacgtattcgttacg

SEQ ID NO: 146303 - DNA, 558 bp, Homo sapiens
  misc_feature: GYAE6OF02H4UUQ.21.4.A04.1.454.CMB.1.raw
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtgacccacaacataggactcgggtccgccaggcctccgagggagggctggagtgggtcggccgtagtacgaaggaagctaacagttacagtacagaatacggcgcgtctgtagaaaggaggttcaccatctacgaaagngatagattacgaaagactcactgtatcagacaaatgaacngacctagaaaaccgnggaaccgacggtccgtagttattagttggtaggtaacgtaaacgaaaggtagtagggtatggtaggttagggtagtcgtggtaacg

SEQ ID NO: 146304 - DNA, 600 bp, Homo sapiens
  misc_feature: GYAE6OF02ITKF6.21.4.A04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (427)..(427): a, c, t, g, unknown or other
  misc_feature (427)..(427): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatacgcctggtaccagcaagaagcctaggccaggctcccaggttccncatctatgcgtcggtcccagagggcccacgtggccacgtcccgaagtactaggttcaggtacggcaagggttcgggtactggggacagaccttcaactctacatcattagcaggtactggacgcctagaaacgtntttcgcgaagttgttaacgttacttggtccaaggcctaaggtatacggtaacttccgtaccgttgttacggtcggttaccgaccgtaagggtacccgtaaagggttacgaaacgttacggaaaaccgtaacgtcggtacggacgttacgacccgtaacctagtacccttacgg

SEQ ID NO: 146305 - DNA, 826 bp, Homo sapiens
  misc_feature: GYAE6OF02JX6LX.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagtaaattgtgttgacgcagtctccaggcaccctgtctttgctccgaggggaaagacgccaccctctcctgcagcctccagcccagaatactccagagcctaactacatacgcccttaggtaccagtcaagaacgccctggaccaggccctcccgaggttccctcactccttagtcgccgttcgggtccccacgaccggggtcccaacgttgggcccaacgttacccccgaaggtaaccgtaacgggttttccgaaacgggttccggggacgttaacgggtttcggggggttacccgttacgggggaaacccgtaaggtttaacccgtttacccgtacccgtttaccgtttcctaaaccgttaccgttaaacgtttacccggacctaacggggtaacccgtggggtaaccgtacccgttaagggtaaacgttacgttttaaccggacggttacggttacgttaacgttacgttacggttacgaggtaccgttaagttaaggttaccggttaaacgtttaccgaaccgtttgtaccggtttacccgggttaccgggacccggttaaacggggtaccctaaaaggggttaacgtaaaacggttaacggaaaaccggttaaccggttgggtaaccggttaccgtacggaaccccgtaaccgtaccgtttaccggtttaccgg

SEQ ID NO: 146306 - DNA, 562 bp, Homo sapiens
  misc_feature: GYAE6OF02FWXJC.21.4.A04.1.454.CMB.1.raw
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagtcgtcgctcgcacgaccggtgctcgatttagagtagtgatcaggggagctctgagagcggagccccggccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggaggtccctgagactctcctgtgcagcctctgcattcaccttcagtgaccacaacatggactgggtccgccaggcctccgagggagggctggagtgggtcgcgtatacgaaggaagctaanagttacagtacagaatacggcncgtctgtagaaaggacgttcacatcacaagagatagatacaaagtactacacttgtatctagacaaatcgaacacgacctaagaaaccgagaacgaccggtcgtagttacttagttaggtaggtaacgaacgtaaaaggtaggttagggtaagttgggtagggttaggtaggtcgttaggtagtaaccg

SEQ ID NO: 146307 - DNA, 553 bp, Homo sapiens
  misc_feature: GYAE6OF02GFUVB.21.4.A04.1.454.CMB.1.raw
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (522)..(522): a, c, t, g, unknown or other
  misc_feature (522)..(522): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccnccaggctccgagggagggctggagtgggtcgcgtatacgaaggaanctaacagttacagtacagaatacggcgcgtctgagaaaggaggttcacctatctacaagagatgaattacaaaagtactacacgttgtatctagaactaaagtagaacagaccgtaagaaaaccgaggaacacgggtccgtagtacttagttaggtaggtaacgaacgaaaaggngtaggagttggtaggtaggtagcgtagtacg

SEQ ID NO: 146308 - DNA, 526 bp, Homo sapiens
  misc_feature: GYAE6OF02IY2JV.21.4.A04.1.454.CMB.1.raw
  modified_base (215)..(215): a, c, t, g, unknown or other
  misc_feature (215)..(215): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (497)..(497): a, c, t, g, unknown or other
  misc_feature (497)..(497): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtcgtggggganacttggtccagcctggagggtcccctgagactctcctgtgcagcctctgcattcaccttcagtgaccacaacatggactgggtccgccaggctccgagggagggctggagtgggtcggccgtatacgaaggaanctaacngttacagtacagaatacggcncgtctgtagaaaggtagtacacatctacaagagatgatacaaagactcactgtatctagacaaatgaacagacctagaaaccgagacacggcctagtattagttggtagtagaactaaagngtaggaatggtggtggtagtcgtagtacg

SEQ ID NO: 146309 - DNA, 678 bp, Homo sapiens
  misc_feature: GYAE6OF02J1GF5.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatactccagacgctaactacatacgcctaggtaccagcagacgccgtggccacggcctcccgtacggttccctacacttctactcggccgtcgggtccccaacggacggggccctacggtcggacctactccccgaaggtaccgacggtttccaagggtcgcgtacgggtcgggtcgtagggactaggtacctttaccgacttctactaacgtactaacgttacggactaacgggacgttacgggaacgtccgttaaggaagttacgtttccggtaacgtacggtttagttacttacgtacgtcgtaacgactaaggttaggttaacggttactttaccgtaccgtcgttcggttaccgtcggaccggtaacgggacgtaaacggtaacgtaaagtacggtaaacgtacgtaggtacggtaccgacgtaccaacgttaccttcgttacg

SEQ ID NO: 146310 - DNA, 722 bp, Homo sapiens
  misc_feature: GYAE6OF02HWOJG.21.4.A04.1.454.CMB.1.raw
  modified_base (234)..(234): a, c, t, g, unknown or other
  misc_feature (234)..(234): n is a, c, g, or t
  modified_base (703)..(703): a, c, t, g, unknown or other
  misc_feature (703)..(703): n is a, c, g, or t
tcagtcgtcgctcgcacgaccggtgctcgatttagagtagtgatcagggggacgagctgctcaggtttaggaccctaggtagggggaaccagtaggaaacccccagccggcccaggctttctcgttcctcctggcctactctggcctccgagctcagaaccacggagtaaattgtgttagacgcagtctccgagggcctacccgtgtacgttttcgtcctaccgaaggggaaancgcccacccctctccctgcagctccagacccaagaatactcccgaagacgaccttaactaacgattacgccgttacggtacccagcaaggaacgccgtggacccgaggtcctaccccgtaggtttccctacgacttcgtaattcggaccgttcggggtacccccacgacggggccctaacgtcggctaacctcccgagtaaccgtacggttccgaggttcggacgtagggttcgggtcgtacggggaactacgggttacttaccgacttcctaaccgaacctaactaccaaacctaacctacggtccggaccgtacgttaacggaagtttacgttttacgaccgttaagtttcgttaactttacgtacggtactaggtattaggtagttcgggtacgtcgtaaccgttacttaccggtttagaccggtaggaccgtaggtggagtagtacacggtacgacgtgcggtcncgactaccgtatgttaccg

SEQ ID NO: 146311 - DNA, 628 bp, Homo sapiens
  misc_feature: GYAE6OF02I66J7.21.4.A04.1.454.CMB.1.raw
  modified_base (201)..(201): a, c, t, g, unknown or other
  misc_feature (201)..(201): n is a, c, g, or t
  modified_base (271)..(271): a, c, t, g, unknown or other
  misc_feature (271)..(271): n is a, c, g, or t
  modified_base (383)..(383): a, c, t, g, unknown or other
  misc_feature (383)..(383): n is a, c, g, or t
  modified_base (447)..(447): a, c, t, g, unknown or other
  misc_feature (447)..(447): n is a, c, g, or t
tcagtcgtcgctcgcacgaccggtgctcgatttagagtagtgatcaggggagagctgctcagttaggacccagagggaaccatggaaaccccgagcgcagcttctcttcctcctgctactctggctcccaggctcacgaaaccaccggagaaattgtgttgacgcagtctccaggcacctgtctttgtctccaggggaaangccaccctctcctgcagctccagtccaagaatactccagacgctactacatagcctggtaccagcagaancctgggccaggcctcccgaggttccctacatacctatcgcgtcgggtccctacgacggccacgtgcctatcccgagacctaggttcaggtggctacgggtggctacgggaanacggacttccattcctagtactacagttagactagactggtacaccgtagaacgtagttcgtanacgtagtacgttactgtacacgtacacggttatacggtacgttaccgtaccttcgttacgttccgggttaccgtacccgggtaacggtaaccgaagggttaaaccgtaaagtaacccggtaaacgtacgtaaacgggttacggtaacggttacgaccgtaaccgtacgttaccgttaacgg

SEQ ID NO: 146312 - DNA, 867 bp, Homo sapiens
  misc_feature: GYAE6OF02JVVNY.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctcgtcctgccagtcctaccagccaagaattactccagagcctactacagtacgccgtaggtaccagcagaagcctggccaggctcccgaacggtttcccacgtatcctatcgtcgtacgggtccctaccgcgggacccagtccgggcacgtccccaaggaccgtacggtttaccgacggtttacgggaccttaggggtttcggggtccgttttacggggaaccgtacggtaacccgtttacccgtaccgttaccccggtttacaaccgtttaccgtaaaccgtttacgggtaaccgtaaccgggtaaccggttaccgggtaaccgggtacccgttaacggttaaacggtaacggtttttaccggaaccgttagggttaccggtttaaacggtttaaccgtttccgggttaacgtaaccggttcgtaacggtttaccggttaacgggttaaaccggttttacccggtaacccgtttcccggtttaaccggtttacccggggttttaccccgggtacccggttaaacccgggggttaacccgggtaaacggggttaaaccgggttaaaacgttaaggggtaaaacccggttaacggttacgggttacgggtaccggttacggttacccgtaaccccgttacggttaccgttttaacccgg

SEQ ID NO: 146313 - DNA, 513 bp, Homo sapiens
  misc_feature: GYAE6OF02GMMJR.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggcctcccaggttcctnatctatgctgggtcccagagggccatggcatcccagacaggttcagtggcagtgggtctgggacagtacttcgactctacatctattagcagactggagtcctgaagtatttcgctagtgtattactgtcagtcagtataggtaagttcacttctcgtcgttcggaccagggacctaaggtagaaacgtgaaacgtacgtgtacggctcgacacctatctcg

SEQ ID NO: 146314 - DNA, 590 bp, Homo sapiens
  misc_feature: GYAE6OF02HBM6C.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatacgcctggtaccagcagaacgcctggccaggcctccccgaggttccctcatctatcgcgtcgggtcccacgagggccacgtggcactcccagacaggttcagtggcaggtgggtctgggacagtcttcactctcatcattagcagacgtgggacgtccgtagaacgtacgtttcgactagttcgttattactgtacagtcgtagttagtaggtaacgttcctaccgttcgttcgttccggttaccggaccgtaacgggtaaccgtaaagggtaacgtaaagtacggaaaaccggttaacgttagggttacggtacgtacggaccctaaccgtacttcgttacg

SEQ ID NO: 146315 - DNA, 612 bp, Homo sapiens
  misc_feature: GYAE6OF02JE4JU.21.4.A04.1.454.CMB.1.raw
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (427)..(427): a, c, t, g, unknown or other
  misc_feature (427)..(427): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
  modified_base (554)..(554): a, c, t, g, unknown or other
  misc_feature (554)..(554): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtcgtgggggagacttggtccagcctggacgggtccctgacgactctcctgtgcagcctctgcattcaccttcagtcaccacaacatggactcggggtccnccgaggcctaccgaggggaagggcgtgggagtgggtcggccgtatacgaaggaanctaacngttacagtacagaatcggcgcgtctagtagaaaggacggtttccaaccattcctacgaaagngtaatagaacttaacgaaagtacctacacgttgtaactctaggaactaaagtgaaaccncgtaacctaacggaaaaacccgnggaaaccaccgggacttaggttactttagtcgggttaacggtaanaaacgtaaaaggtgttaggaaggttggtagggttaggtaacggtccgtagggtaaccg

SEQ ID NO: 146316 - DNA, 739 bp, Homo sapiens
  misc_feature: GYAE6OF02HYWKA.21.4.A04.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaaccaccggagaaattgtgttgacgcagtctccaggccacctgtctttgtctccgaaggggaaancgccaccctctcctgccagctaccagccagaactacnccgagagctactacatacgccttacggtaccagcaaggaacgcctaggccaggccttcccgtaggttcctactattcctagtggccgttacgggtcccaacggtaccggggcctaacggtcggacctacgttccccgaaggtaccgtacggtttcacggttggcagggttcgggtactcggggaactacggtacctttccgaacttccgtacgtaacgttacgtaacgtttacggacgtacggtacgtagggacgtaccgttaggtaacggtagtttaccggacgttaggttacgttaacgtttacgtacgtaccgtagtacgttaaggttacgttaacggtaccgttaccgtaaccgtttacgttcggttcccggtttaccgggaaccgttaacggggtaacccgttaaagggtaaacgttaaacggttaacgaaaccggttaacggtacggttacgggtaccgtacggtaaccgtaaccgttacgttaccgttaaccgg

SEQ ID NO: 146317 - DNA, 517 bp, Homo sapiens
  misc_feature: GYAE6OF02FKBBA.21.4.A04.1.454.CMB.1.raw
  modified_base (201)..(201): a, c, t, g, unknown or other
  misc_feature (201)..(201): n is a, c, g, or t
  modified_base (355)..(355): a, c, t, g, unknown or other
  misc_feature (355)..(355): n is a, c, g, or t
  modified_base (390)..(390): a, c, t, g, unknown or other
  misc_feature (390)..(390): n is a, c, g, or t
  modified_base (514)..(514): a, c, t, g, unknown or other
  misc_feature (514)..(514): n is a, c, g, or t
tcagtcgtcgctcgcacgaccggtgctcgatttagagtagtgatcaggggagagctgctcaagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatgctgggtcccacgacgggccacgtggcactcccagacaggttcagtggcagtgggtcngggacagcttcactctcatcattagcagactgganccgtagaagtatttcgctagttgttattacgtgtcagcagttagtggtaagttcctactctgtccgttcgcctagggaccaaggtaagaaagtaggaaacgaacgtggtacgctagacactatntcg

SEQ ID NO: 146318 - DNA, 533 bp, Homo sapiens
  misc_feature: GYAE6OF02FMWW0.21.4.A04.1.454.CMB.1.raw
  modified_base (195)..(195): a, c, t, g, unknown or other
  misc_feature (195)..(195): n is a, c, g, or t
  modified_base (523)..(523): a, c, t, g, unknown or other
  misc_feature (523)..(523): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggaccaggcctcccagtctcctcatctagtggggcatcctacaggatgaccggcactcccagacaggttcagtcgccaggtggtctgggacagtacttcactctcactataccaacacacgtggccgaccgtagaagtacttttgactagttacgttattacgtgtactagattgtagtggtagtcaccgtactaccgtttggaccgtaggggacctaaggtgagagtacgagtacgagtggtggctgcctacatctgtctcncttcctcctc

SEQ ID NO: 146319 - DNA, 742 bp, Homo sapiens
  misc_feature: GYAE6OF02GVOHA.21.4.A04.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagcctccagccagaatactccagagctactacatagcctggaccagtcaagaacgcctggccaggcctcccaggttcccnactctatgcgtcgggtccccagacgggccaacgtggcctactcccgaagacgtaggttccaggtcggacagggttgggttactcggggaactagtaacctttcaacgtcctacgaacttcgaacgtttacgacgaacggtacgtacgggtacgtacccgttaagaacggttacgttttccggaccgttaaggtttacgttacgtttaccgttagtaccgtaacggtacggttaacggtttacggtaacggggtttaaaccgttcccgttaacccgttccggtttacggtttacccggggtttacgggaaaccccgggttaaacggggtaaccccgttaaaaggggttaaaaccggtaaacgtttaacggggaaaaacccgttacggtttcgggtaacgggtccgttaaaccggtacccgtaaccgttacggttccgtttaacccgg

SEQ ID NO: 146320 - DNA, 583 bp, Homo sapiens
  misc_feature: GYAE6OF02G8DB2.21.4.A04.1.454.CMB.1.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
  modified_base (537)..(537): a, c, t, g, unknown or other
  misc_feature (537)..(537): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccaggcctgggagggtccctgagactctcctgtgcagcctngcattcaccttcagtgaacccacaacatgggactgggtccnccgaggcctccgaggggaaggggctgggagtcggggtcggccgtatacgaaaggaagctaaacagttaacagtaacagaatacggcgcggtccgtagaaagggacgttcaccatcanaagagatagattacaaagaactcacgtntatctagacaaatgaaacagacctaaggaaaccgagggaaccacggtaccgtagtacgttattggtacggtaagaacgtaaaaggnggttaaggagttaggttagggtaggttaggtacgttggagtaaccg

SEQ ID NO: 146321 - DNA, 622 bp, Homo sapiens
  misc_feature: GYAE6OF02H1HC9.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (290)..(290): a, c, t, g, unknown or other
  misc_feature (290)..(290): n is a, c, g, or t
  modified_base (394)..(394): a, c, t, g, unknown or other
  misc_feature (394)..(394): n is a, c, g, or t
  modified_base (476)..(476): a, c, t, g, unknown or other
  misc_feature (476)..(476): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaangccaccctntcctgcagctccagccagaatanccaganctactacatagcctaggtaccagcaggaagcctggccaggcctccaggttccncatctatcgctcgggtcccagacgggccacgtggccactcccgagaccgaggttcaggtcggcgtaggttggggtactaggggacaaggtacttccaaccgttntaccaagttcctaatttagcctaaggtacgtgggtaacgtccgtaggaacgtagtttccgacgtaagttgttaactttacgngtccaaggcgtagttagtacggtaaacgtttccaaccgttgttcggtacggtttccggaaccggttaacgggaccgtaagggtaaacgtaaagtacggtaaacgtaacgtggtacggactaggtacccgtactcgttacgttaccg

SEQ ID NO: 146322 - DNA, 724 bp, Homo sapiens
  misc_feature: GYAE6OF02JYF3G.21.4.A04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
tcagtcgtcgctcgcacgaccggtgctcgatttagagtagtgatcagggagagctgctcagttaggacccagagggaaccatggaacccagcgcagcttctcttcctcctgctactctggctcccagctcagaaaccaccggagaaattgtgttgacgctagtctccaggcaccctgtcttgtctccaggggaangccacctctcctgcagcctccagccagaatatccagacncttaacacagtacgcctggtaaccngcaagaacgcctggaccaggtcctacccgacggttttaccctcgaattctaacgtcgaccgtcggggtaccccaacgacggggccctactgggcctaactcccgaagtaacccggagtttccaacggttcggctaagggtttccggggtctacggggtaacccagggttaacccctttcggtaaccctaccttttacgaactaccggttaacgtttacggacccgtaggtaacccgtcgggtactacccgttagtaaaccgtagtttccgaccgtaagggtttacttaacgtagttaccgtcgtaagtaccgtagttaccgtaggttaaccgttacctacctttacgttcggtaacgtttccggacgtaaccggggtactaaacgggtacgttaaaacgttcgaaacccggtaaagtttaccgggtcgggtaacttaccggacgtaaacccgtgttacccttagg

SEQ ID NO: 146323 - DNA, 785 bp, Homo sapiens
  misc_feature: GYAE6OF02IEKC8.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggccaccctgttctttgtctccgaaggggaaanacgcccacctctcctgcagctcagccagaatactccagacgctactacaatacgcctacggtaccaagcaaggaacgccgtcggcccgaacgggtcccttcccgtaacgggtttccctacctagttaccttaagttcggccgttccgggtaccccacggaccgggcctacgtcggactacgtcccgaagtaccgtaggttaccgaggttcgggcgtagggtcgggtcgtacgggggaactaacggttacttaccgaccttcgtactacgtacgtacgttacggcgtacggtaaccggtgggaacgtaccgttaacgggtaacggttacgtttaccggtacgttaacggtttacggttaacttttaccggtaggtacctacggtaacgttacggttaaggttacgggtaacgtttcccgtacgtttaccggttcggttcccgggttacccgggtaaccgggtaacgggttaaccggtaaaggggtaaacggttaaacggtaaccggtaaaaaccggttacggttacggggttacgggtacgtacccgggtaacttaacccggtacgtttaccgtttaccgg

SEQ ID NO: 146324 - DNA, 753 bp, Homo sapiens
  misc_feature: GYAE6OF02GWFEZ.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccacctctcctgcagctccagccagaatatccagagctactacatacgcctaggtaccagcagaacgcctggccaggcctcccgaggttcctacattcctatcggcgttcggggtaccccaagacggggccctaacgtgggaccaacgtccccgaagtacctaagggtttccaagggttcggaccgtaagggtttcggggttacctacgggggaacctaacgggtaccctttaccgaaccgtttccgtacgtaacttaccgtaaacgttttacggaccgtaaacggtaaccgttggggaacgtacccgttaagggaaacgttacgttttaccggacgtaacggtttacgttaacgtttaaccgttcggttaccgtaacggtaccgtaaaggtttacgttacggggtaaacgttttaccgtaacccgtttcgttacggttacccgggtttaccgggaaccgtaaacgggaaccgtaaagggtaaacgaaaagttacggaaaaccgtaacgtaggtacggtaccttacggacctaaccgtacgttacgttacg

SEQ ID NO: 146325 - DNA, 577 bp, Homo sapiens
  misc_feature: GYAE6OF02G8DS7.21.4.A04.1.454.CMB.1.raw
  modified_base (201)..(201): a, c, t, g, unknown or other
  misc_feature (201)..(201): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccaccctctcctgcagctccagccagaatatccagagctactacatagcctggtaccagcagaagcctggccaggctcccaggttcctcatctatgcgtcgggtcccacgacgggccacgtggccatccccagacaggttcagtggcgaggtcgggtctgggacagtacttcactctcgatcaattagcagtacgtggagtcgtagtaagtntttcgctagttntattactgtcagctagtagtaggtaagttctaccgttgttcggtccggttacggacccgaacgggtaaccgtaagggtaagtaaacgtaacggtaaaaccgtaacgttacggtacggtacgtacgacccgtaaccgtacgttccgttacgg

SEQ ID NO: 146326 - DNA, 628 bp, Homo sapiens
  misc_feature: GYAE6OF02IY7EH.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagatccaccctctcctgcagctccagccagaatatccagagctactacatagcctggtaccagcagaacgcctggccaggcctcccaggttcctcatctatcggcgtcgggtccccagacggggccctacgtcggccactacccgaggaccgtacggtttcgaaggttcgggacgtagggtcgggtcgtaggggaccaggtaccttcgaccttctctatctaattacgactacgacgtggacgtcctagaacgtctttcgcgtagttagttactttacgtcgtacagtacgtaagttagtagtaacgttctaaccttcgtacggttaccgttaccgggacctaacggggtaacctaagggtaaacgtaaagttacggtaaaacggtacgttaggtacggtaccttaggaccctaaccgtagttccttacg

SEQ ID NO: 146327 - DNA, 514 bp, Homo sapiens
  misc_feature: GYAE6OF02FJQS6.21.4.A04.1.454.CMB.1.raw
  modified_base (195)..(195): a, c, t, g, unknown or other
  misc_feature (195)..(195): n is a, c, g, or t
  modified_base (313)..(313): a, c, t, g, unknown or other
  misc_feature (313)..(313): n is a, c, g, or t
  modified_base (385)..(385): a, c, t, g, unknown or other
  misc_feature (385)..(385): n is a, c, g, or t
  modified_base (440)..(440): a, c, t, g, unknown or other
  misc_feature (440)..(440): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaanagttactctctcctgcaaggccagtcagagttgttggcatcgacgttgccctggtaccaacaaaacctggccaggctccagtctcctcatctatggggcatcctacaggatgaccggnatcccagacaggttcagtgccaggtgggtctggggacaggtacttcactctcaaccatcaacacactgggcncctgaagtattttgctagtgtattactgtcagattgtatggtaggtcaccgtacnctttggccgagggaccaagggtgagagtcagacgatggtggctgctacgatctcgttctctacttctccctacc

SEQ ID NO: 146328 - DNA, 656 bp, Homo sapiens
  misc_feature: GYAE6OF02I3XIS.21.4.A04.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (268)..(268): a, c, t, g, unknown or other
  misc_feature (268)..(268): n is a, c, g, or t
  modified_base (376)..(376): a, c, t, g, unknown or other
  misc_feature (376)..(376): n is a, c, g, or t
tcagtcgtcgctcgcacgaccggtgctcgatttagagtagtgatcagggagagctgctcagttaggacccagagggaaccatggaaacccagacgcagctctcttcctcctcgctacctctggctcccaggcctcagaaaccaccggagaaattgtgttgacgcagtctccagcacctgtcttgtctcgagggaanatcccacctctcctgccagctaccagccagaatactccagagctaactacanacgctggtaccagcagaacnctcggccacgctaccgaggtttccctatcctagtcgcgtcggtacccaaacggccctaacgtggcctactaccccagcgtaagttcgacgtagtcgaggttcggggtntcggggaacagtaccttcacgtcctcgtaatctacgtaagtcacgtaccggtaggtacgaccgttacggaaagttactttacggacgttagttacggttactttaacgttcgtaggtacgaacctaggtttaacgtagggttaacgtttacgacctttcgttacgtccgtttagggaaccgtaccggtaacggtaacgtaaggtaaaggtaacgaaacgggtaaccgttagggtacggtaccgttacggaaccgtaaccgtacttaccggtattacccgg

SEQ ID NO: 146329 - DNA, 529 bp, Homo sapiens
  misc_feature: GYAE6OF02FULG7.21.4.A04.1.454.CMB.1.raw
  modified_base (374)..(374): a, c, t, g, unknown or other
  misc_feature (374)..(374): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagcctggagggtccctgagactctcctgtgcagcctctgcattcaccttcagtgaccacaacatggactgggtccgccaggctccgagggaggggctggagtgggtcgcgtatacaaggaagctaacagttacagtacagaatacggcncgtctgtagaaaggaggttcaccatctacaagagatgattcaaagactacactgtatctagacaaatgaacagacctagaaaccgagacacggacgtagtattagtggtaggtaagacaaagtggtaggattggtggtaggtagtcgtaggtacg

SEQ ID NO: 146330 - DNA, 576 bp, Homo sapiens
  misc_feature: GYAE6OF02IZDIM.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggaaggggctgggagtgggtcggcgtattacgaaggaagctaacagttacagtacagaatacggcgcgtctaggtagaaagggagttcaacatctacaagagatgattacaaaagtactcaactgtaactctcgactaaagtgaaacagtacctaaggaaaacccgaggaaccacgggtaccgtagttagttacgttaggtaaggtaacgtaaactaaaaggtcgttaggaagttggtagggttaggtaacgtcgtaggtacg

SEQ ID NO: 146331 - DNA, 770 bp, Homo sapiens
  misc_feature: GYAE6OF02GSFRL.21.4.A04.1.454.CMB.1.raw
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcggtgttcgtgtaggtnttacaagtgtcagtgtgaggtgcagctggtgagtcgtgggggancttggtccagcctggagggtccctggagactctccgtgtgccncgccgtcgtcgtctacttacctaccttcgtacgtacgaccacaacagtacggtacggtcggtccggccgacggtccgtaccggacgggacgggtcggtgggtagggtcgggtaccggtaccggtacgtaacgtaacggaaacgtaacgtaaacgtaacgtaacgtaacgtaacgtaacgtaaacgtacggtacggtacgtacgtacggtaagggtaaacgggtaacggttaccgtaaccgtaacgtacgtacgtaaacgtaacgtaagtaacgtaacgtaacgtaaacgtaaacgtaaccgttaacgttaacgttaacgttacgtacgtaacgtaaacgtaacgtaacgtaaccgtaaccgtaaaccggtaaaccggtaaccgggtaaccggtaacccgggtaaccggttacggtttaagttaacggtttacggttaacgggttaaacggtaaacggtaaacggtaaggttaggttaggttacgggttagggttagggtacggttacggtacggtacgg

SEQ ID NO: 146332 - DNA, 633 bp, Homo sapiens
  misc_feature: GYAE6OF02G4GCL.21.4.A04.1.454.CMB.1.raw
  modified_base (189)..(189): a, c, t, g, unknown or other
  misc_feature (189)..(189): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (387)..(387): a, c, t, g, unknown or other
  misc_feature (387)..(387): n is a, c, g, or t
  modified_base (454)..(454): a, c, t, g, unknown or other
  misc_feature (454)..(454): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcaagaaaccaccggagaaattgtgttgacgcagtctccaggcacctgtctttgtccncgaaggggaaancgccaccctntccngcagcctcagcctagaactnccagagctaactacatacgcctaggtaccagcaagaagccgtggccaggctccgaggttccncatcatgctcggccagcggccacgtggcactcccagactaggttnacgtggctagggtggtcgtaggggactaagtacctttcaccgttnacctataccgtagttacgcgaacgtaacgtggacgtacgtagaacgtacgttttacgacgtaggttntaacgtttacgtagtcgaagttacgaagttagtacgggtaaacgttccgtaccttcgtacgtttcggttaccggaacccggtaacgggtaacccgtaaagggtaaaggtaaaacgtacggtaaaaaccggtaaccgtgggttacgtaccgttaggaaccctaccgttagttcgttaccg

SEQ ID NO: 146333 - DNA, 559 bp, Homo sapiens
  misc_feature: GYAE6OF02IOHOV.21.4.A04.1.454.CMB.1.raw
  modified_base (202)..(202): a, c, t, g, unknown or other
  misc_feature (202)..(202): n is a, c, g, or t
  modified_base (306)..(306): a, c, t, g, unknown or other
  misc_feature (306)..(306): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccacccctctcctgcagctccagccagaaatatcccaagacgccttaactacatagcctaggtaccagacaagaacgcctggccaggcctcccgaggttccncatctatgcgtcggtcccagacggtccagtggccactcccagactacggttcaggtcggctagggtgggtctagggacagtacttcgactttcgacatacatagacagtacgtggacgtctagaagtnttcgatagtntattcgtgctagctagtatggtactcgtactcgtgtccgtacgacgacgggtaacgtaggtaacgaagttacggaaacgtacgttgtaggtacgtacgacctaactagtcttacg

SEQ ID NO: 146334 - DNA, 818 bp, Homo sapiens
  misc_feature: GYAE6OF02HKGIW.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaccacggagtaaattgtgttgacgcagtctccgaggccacctgttctttgtcctacgaaggggaaancgcccacccttctcctgcacgcctccgagaccaagtaactactccgaagacgcctaactacagtacgccgttacggtaaccagacaacggaacgccgtacggacccaacggtccctacccgtacggtttccctactacttccttaagtcggtaccggttccgggtaccccaacggtacggggaccctacggttcgggacctaaccgtaccccgaagtaccgtaacggtttaccgacgggttcgggaccgtaaggggttcgggtaccggttacgggggaactaacggtaccctttaccgaccttaccttacgtaacttacgttaacgtttacggaaccgtaagggtaccgttaggggaaaccgtaccgttaaggtaaacggtttacgtttacgaacgttaggttacgtttaacgtttacgttacggtacgtacgtacgtaacgttaaggtaacgggttaaccttaccgtaccgtttcgttacgggttaccgttacccgggaaccgtaacgggtaaacccgtaaaggggttaaactaaacgttaaacggtaaaaccggttacggttacggtacggtaccgttacgaaccgtaaccgttacgttacgtttaccgg

SEQ ID NO: 146335 - DNA, 599 bp, Homo sapiens
  misc_feature: GYAE6OF02IO2PJ.21.4.A04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagtaaattgtgttgacgcagtctccaggcaccctgtctttgtctaccgaggggaaangccaccctctcctgcagctccagccaagactatccagagctactacactagcctggtaccagcaggacgtcctggccaggcctaccgaggttccctanactctatcgcttcgggtcccagacgggccacgtgcactcccagacnggttcgagtggctaggtgggctgggaccagtaccttcacttccgntaatcgtacgtagcgtaacggtgtacgggacgtccgtagtaacgtctttgtcgaagttcgttattacgttggtctacgattacgtagtacgtaacggtttcaccgttgttacggttcggttaccgtaccgaagggtaccaaggtaacaaacgtcggtaaacggtacgtaggttacggacgtaccggtactaccgtagttccgttacg

SEQ ID NO: 146336 - DNA, 675 bp, Homo sapiens
  misc_feature: GYAE6OF02H2KZR.21.4.A04.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagaaattgtgttgacgcagtctccaggcaccctgtctttgctccgaggggaaanacgccaccctctcctgcagctccagccagaatatccagacnctactacatgcctaggtaccaagcaagaacgcctggccaggctccccgaggttccactatcctatcgccgtcgggtccccaacgacgggccacgtcggcaactcccgaagacgacggttcaggtggcagggtggtcgtgggacaaggtccttcacttcgtacctatactaatttagcgtaaggtacgtagggacgtacccgtaggaaacggttaagttttaccgaacgttaggttagttaactttaaccgttacggtaccgtaaacgtacggtaaggttacgttagggtaaacggttaccttaaccgttcgttacggtaccggtttccgggaaccgtaacgggaccgtaaacgggtaaggtaaaacgtaaggtaaaaccggtaacgttacggtacggttacgtaacggtacctaaccgtagttaccgttacgg

SEQ ID NO: 146337 - DNA, 741 bp, Homo sapiens
  misc_feature: GYAE6OF02HY0VP.21.4.A04.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtcctcgaggggaaancgcccaccctctcctgcagcctccagccagaactatccagacgctactacagtacgcctggtaccagcagaacgccgtggccaggcctacccgaggtttccnctatctatggctcgggtcccagacgggcctacgtggcctactccccgagtaccgtaggtttaccaggtcggctagggtcgggtacgtacgggactaacgtacctttccgaccgtttctaccgtaattaccgtaacgtttacggaccgtaaacgttaccggtaggggtaccgtacccgttaggtaaacgtttaccgtttaccggacgttaggttacggtttaactttaaccgtcggtaaccgtaaggtaccgtaaagggttacggtaacgggttaaacgtttacccgtaccgtttccgtttacgggttccgggtttacccgggaaccggtaaaccggggtaaccgttaaaggggtaaacgttaaaacggtacggtaaaaccggttaacggtttcggtaacgggtacctaccggaacccgtacggttaccttacgttccg

SEQ ID NO: 146338 - DNA, 788 bp, Homo sapiens
  misc_feature: GYAE6OF02H68CK.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaanagccaccctctcctgcagctccagccagaatatccagagctactacatagcctggtaccagcagaacgcctggccaggcctcccgaggttcctcatctagtcgcgtcgggtacccacgacgggtcccacgtggcactcccgagacgtaggttcaggtggacgaggtgggtctggggaccagtacctttcgaccgttcctacgtacttacctaagtttaacggaccgtaaggtaaccggttacggggtaacggtaccccggttaagggtaaacgggtttaaccgtttttaccggaccgtttaagggtttacggtttaaccgttttaacgttacgggtttaaccgtaacgggttaccgttaaaggtttaacggttaacgggggttaaaccgtttacccgttaacccgtttaccggtttacgggttttacccgggtttacccggggtaacccggtaaaccgggggtaacccggttaaaacgggggttaaaggtaaaaaccgttaacggggtaaaaaacccgggttaacgttacggggtttaccgggaccgttaaccgggacccgttaacccgttaacgttaccgtttacccgg

SEQ ID NO: 146339 - DNA, 579 bp, Homo sapiens
  misc_feature: GYAE6OF02IX946.21.4.A04.1.454.CMB.1.raw
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
  modified_base (423)..(423): a, c, t, g, unknown or other
  misc_feature (423)..(423): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaagagccaccctctcctgcagctccagccagaatatccagacgctactacatacgcctggtaccagcagaagcctggcccaggcctcccaggttccncatctatgcgtcgggtcccacgacgggccactggcatcccgagacnggttcagtgcaggtggctagggacagacttcactctacatcagttagcagacgtggacgccgtaggtaacgtactttcgngtagttgttacttacgtcgtacagtctagttagtaggtacgtttccaccgttcttggttacccggttcggaccggtaacggggaacctaaagggttaacaaaggtaacggtaaaacgtacgttaggtacgacgtacgaaccacctacgtcgttacg

SEQ ID NO: 146340 - DNA, 544 bp, Homo sapiens
  misc_feature: GYAE6OF02HS71L.21.4.A04.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (376)..(376): a, c, t, g, unknown or other
  misc_feature (376)..(376): n is a, c, g, or t
  modified_base (499)..(499): a, c, t, g, unknown or other
  misc_feature (499)..(499): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagctactacatagcctggtacagcagaagcctggccaggcctccaggttccncatctatgctcggtcccacgacgggccacgtggccacgtcccgagtacaggttcagtggcaggtgggtctgggactagacttcactntcatcattagcagactggagtccgtagaagtagtttcgacgtaggttgttagttacgtgtacgagtcgtaagtagtagtaacgttctaccttcgtgtcgtcgacgtacgggacgtaaggtaanaagtaacgaacgtaacgtggtacggtacgtcgacactatactacg

SEQ ID NO: 146341 - DNA, 780 bp, Homo sapiens
  misc_feature: GYAE6OF02IWDGR.21.4.A04.1.454.CMB.1.raw
  modified_base (196)..(196): a, c, t, g, unknown or other
  misc_feature (196)..(196): n is a, c, g, or t
  modified_base (310)..(310): a, c, t, g, unknown or other
  misc_feature (310)..(310): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgctcgagggaancgccacctctcctgcagcctccagccaagaatactccagagcctaactacatacgcctggtaacccagaccaagaacgccgtggacccagggtcctacccgtaaggtttccccncgtaacttccgtaagtcggtaccgttccggggtacccccaacggacggggccctaacggttcgggaccctaacgtaccccgaaggtaccgtaacgggtttccgaacggtttcgggaccgtaagggtttcggggttacccgtacgggggtaacctaacggtaccctttccgtaaccgttccgttaacgaaccgttacgtaacgtttaacggaccgtaacggtaaccgttgggaacgtccgttaaggaacggttactttaccggacgttaaggtttcgttaaactttacgtcggttacgaaggtaccgttaaggttaacgttacggtaaacgtttacccgacgtttacgtcggtttaccggttaaccggaccgtaaacgggtaacccgtaaagggttaaacgtaaacgtaacggtaaaaccgtaacggttcggacgttaccggtacgaccgtaacccgtagttccttaacgg

SEQ ID NO: 146342 - DNA, 587 bp, Homo sapiens
  misc_feature: GYAE6OF02H7LRV.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaagagccaccctctcctgcagctccagccagaatatccagagctactacatagcctggtaccagcagaacgcctggccaggctcccaggttcctcgatctatcgcgtcggtcccacgacgggccacgtcggcacgtcccgagacgtacggttcaggtcggcgtaggtcgggtcgtgggacagtacttcactctacatcgattacgcacgacgtcggatccgtagaacgtctttacggctagttctattacgtgtacgagcgtaagtagtaggtaacgttcaccttcgtcggttccgttcggaccgtaacgggtaccgtaaagggtaacgtaaacgttacggaaaacgtacgttaggtacggtacgtcgaccgtaccgttacgttcgtacg

SEQ ID NO: 146343 - DNA, 546 bp, Homo sapiens
  misc_feature: GYAE6OF02GC30T.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggctcccaggttcctcatctatgctgggtcccacgagggccactggcatcccagacaggttcagtgcagtggtctgggacagacttcactctacatcattagcagactggacgcctagaacgtatttcgactagttgtattactgtcagtcagttagtggtaagttccaccgttctcggttccgttccggaccgtaacgggtaccgtaagggtaacgaaagttacggaaacgtaacgtggttacggcgtacgaccaaccgtactcgttacg

SEQ ID NO: 146344 - DNA, 824 bp, Homo sapiens
  misc_feature: GYAE6OF02GMD2Y.21.4.A04.1.454.CMB.1.raw
tcagtcgtcgctcgcacgaccggtgctcgatttagagtagtgatcaggggaggagctgctcagttaggacccagagggaaccagtggaaaccccagcgccagcttctcttcctcctgctactctggctcccaggctcagaaaccgaccggagaaattgtgttgacgcagtcctccaggcacccgtgttctttgtctccgaggggtaaagcgccacccgttctacctgcaggcctccagccaagaactactccagacgctactacatacgcctaggtaccagctaaggaacgtccgtacggacccagggtccctccccgtaacgggtttcccctaccgtaagttaccgttagtccggtaccgttccggggtaccccaacggtaccggggcccttaacggtcgggtacctacgttaccccgaaggaacgttacggtttccgaggttcggtcgtagggttcgggtcgtaggggaactacggtaccgtttccgaacctttccgtacgtacttaccgtaatttaaccggctaacggtaccgtagggtaaccgtccgtaacggtaacgttacgtttacggacgttacgggttacgttacgtttaccgtcgttaccgtaacggtacgtaacggttacggtacgggttaaacgtttcccgtttaaccgtttccggttacggtttacccgggttacgggaaccccggttaacggggaacccggttaaaggggtaacgtttaaaacgggttaccgggtaaaaccgttaaccgggtttagggtaaccgggttcgttaaccggtacccgaaccggttacgttacccgttaaccggg

SEQ ID NO: 146345 - DNA, 581 bp, Homo sapiens
  misc_feature: GYAE6OF02H52FP.21.4.A04.1.454.CMB.1.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (414)..(414): a, c, t, g, unknown or other
  misc_feature (414)..(414): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggganacttggtccagccgtggagggtccctgagactctctgtgcagcctntgcattcaccttcagtcgaccacaacatcggactgggtccgcaggctccgaggggaggctggagtgggtcgcgtatacgaaggaacgctaacagttacagtacagatacggcncgtntgtagaaggtagtcacatcacaagagatgtatanaaagactacactagtatcagacaaagtagaactacgaccgtaaggaaaaccgtaggaaccgaaccgggtaccgttagttacgtttacgttagggtaacgggtaaacgtaaacgtaaaaaggtcggtaaggtagttagggtaggttagggtagtccgtaggtaaccgg

SEQ ID NO: 146346 - DNA, 592 bp, Homo sapiens
  misc_feature: GYAE6OF02I3OU9.21.4.A04.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctctcctgcagcctccagcccagaatatccagagctactacatagcctggtaccagcagaacgccgtggccaggcctcccgaggttcccncgatctatcgccgtcgggtccccacgacgggcctacgtggacctactcccgagacgtaggttcaggtcggctagggttgggtctgggacagtcttcgactctcatactattacgcaacgtcgtggacgccgtagaagtacttcgcgtaggttgttattacgtgtacacgataaggttagtaggtaacgttccgaccgttcgtcggttaccggtaccggaccgtaacgggaccgtaagggtaagtaaagtacggaaacgtacgttaggtacggacgtagaccaacgtctcgttcg

SEQ ID NO: 146347 - DNA, 602 bp, Homo sapiens
  misc_feature: GYAE6OF02HTYRK.21.4.A04.1.454.CMB.1.raw
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (429)..(429): a, c, t, g, unknown or other
  misc_feature (429)..(429): n is a, c, g, or t
  modified_base (511)..(511): a, c, t, g, unknown or other
  misc_feature (511)..(511): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgttcgtgtagtattacaagtgcagtgtgagtgcagctggtggagtcgtggggganactttggccaggcctgggacggtccctgagactctcctgtgcagcctntgcattcaccttnagtgaccacaacatggacttggggtcccnccgagggtcctccgaagggggaagggctgggacgtgggtcggccgtaattacgaaaggtaaacgcttaaacagttacaagtacaagaagtacggcgcgtctgtaggaaaggtagttccacgatcgtacgaaagnggtaatgaacttacgaaaaggtacttcacgttgtaactgttacgactaaaagtcgaaaccgagtcccgtaaagaaaacccgnggaaaccgaacggtccgtagttattttacgaaggtgtaactaacggaataaaagggtgtaggtaatggttagggtacgtaggtccgtaagg

SEQ ID NO: 146348 - DNA, 656 bp, Homo sapiens
  misc_feature: GYAE6OF02GZX8N.21.4.A04.1.454.CMB.1.raw
  modified_base (263)..(263): a, c, t, g, unknown or other
  misc_feature (263)..(263): n is a, c, g, or t
  modified_base (378)..(378): a, c, t, g, unknown or other
  misc_feature (378)..(378): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctcngcattcaccttcagtgaccacaacatggactgggtccgccaggcctccgagggagggctggagtgggtcggccgtatacgaaggaagctaacagttacagtaacagaatacggcncgtctaggtagaaaggtaagggtttccaacctagtacctacgaaagagtaattaggtaattaccgaaaaacggtaccttacaacgttggttaactcctaggactaaaagttcgaaaccaaggtaccctaagggaaaaacccggacgggtaaaccgaaccggggtacccgttagggttaacttttaaggtttacgggtaacgggttaaaggaaacctaaaaaagggtggttacgggtaacgttcgggttagggtacgggtacgtacgtagggttaacgg

SEQ ID NO: 146349 - DNA, 744 bp, Homo sapiens
  misc_feature: GYAE6OF02FZ7CX.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaatactccagagctactacatagcctggtaccagcagaacgcctggccaggcctccccgaggttcccacattctatcgccgtcggggtaccccacgacgggccctaacgtcggacactcccaaggaccacggttcaggtggacctagggttcgggtacgtggggaactagtaccctttcgaaccttccgtaccaaccctactaccaacccgacggtaaccgtcgggacgtaccgtaggtaaacgttacgttttacgacgttaaggttacgtttaacgtttaaccgttacgttaccgtaacgtacgtaaggtttaacggttacgggttaacgtaccgttacccttaaccccgttacccgtaacgtttaccgttaaccgtttaccggtttttacgggaacccggtaacggggggttaaacccggtaaacggggttaacgggtaaaaccgttaaccggaaaaccgggttaacggttacgggttaaccgggtaccgtaccggtaccgtacccgttaacg

SEQ ID NO: 146350 - DNA, 582 bp, Homo sapiens
  misc_feature: GYAE6OF02H7F1G.21.4.A04.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (384)..(384): a, c, t, g, unknown or other
  misc_feature (384)..(384): n is a, c, g, or t
  modified_base (483)..(483): a, c, t, g, unknown or other
  misc_feature (483)..(483): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttcctgttgtatttacagtgtcagtgtgaggtgcagctggtggagtctgggggganacgttgggtccaggcctgggagggtccctgagacttctctgtgcagcctctgcattcaccttcagtgacctacaacatcggactgggtccncaggctccagggaagggctggagtgggtcggcgtattacgaaggtaagctaaacgagttacagtaacagagtacgacgcgtacngtagaaaggtagtcacatctacgaagagatagattacaaagaactccgatagtaactctagacgtaaatacgaacacggaccttaacgggaaaacccgnggaaacaccgggaccgttagtaatttagttcggtaaggtaacgtaaacgaaaaggtagtacggtaagtgggtaggttaggtaacgtcgtaggttaaccg

SEQ ID NO: 146351 - DNA, 689 bp, Homo sapiens
  misc_feature: GYAE6OF02HAR15.21.4.A04.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaanacggcccaccctctccgtgcagctccagccagatatccaganctactacatacgcctggtaccagcaagaagccgtggccacggcctcccgtaacggttcctcaattccgtaatcggcttacgggtccccaacggacgggccctaccgtggcctaaccgtcccgaaggtaccgacgggtttaccaagggttcggcctaagggttcggggtacgttacgggggaactacgggttaacccttctaccgttaccgttaccactacgtactttacgacgtacgacgtacggacgtaccgtaggaagttacgtttacgacgttagtacgttacgtttaacgtgtacgacgtacgtacgttacgtaggtaacttccgtaaccgttcgttacgttccggttacggaccgtaacgggtaacgtaacggtaaggtaaacgtaacggaaacggtaacgttaggtacggtcctacgacgtaccgtacttaccgttacg

SEQ ID NO: 146352 - DNA, 534 bp, Homo sapiens
  misc_feature: GYAE6OF02G8R6O.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttcctcatctatcgctgggtcccagagggccacgtggccatcccagacaggtcagtggcaggtggctgggacagacttcactctcatcattagcagactggagctagaagtatttcgctagttgtattactgtcagtcagttataggtaagttccgaccttcgtgtccgttcggaccgtaacgggacctaagggtaagaaacgtaggaaaaccgtaacgtggtacggacgtggaccaccgtagtcgtacg

SEQ ID NO: 146353 - DNA, 705 bp, Homo sapiens
  misc_feature: GYAE6OF02FYX9K.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgttgacgcagtctccaggcaccctgtctttgtctccgaggggaaanagcccaccctctcctgcagctccagccagaactactccagagctactacatacgcctggtaaccagacagaacgcctggccaggcctcccgaggttccctacactctagtcgccgttcggggtccccaacgacggggcccaacgttcgggacctacgtacccagaccgtagggtttccagggtcggacgtagggtcgggtcgtggggaacctacgtacctttcaccgttcctacgtacttactaagtttacgacgtaacggtacgttcgggaacgtacccgttaagggtaaacgttacgttttacgaacgttaggtttacggttaactttacgtcgttacgacgtcgtaagttagttacggtaagtttaccaccgttcttacggttaccggttaccgggtaacccggtaacgggtaaccgaaagggtaaacggtaaacgttaacggaaaaccggtaacgttagggtacggtaccgtacgtacccgtaacgttacgttccgttacg

SEQ ID NO: 146354 - DNA, 613 bp, Homo sapiens
  misc_feature: GYAE6OF02IYH3F.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaagagccaccctctcctgcagcctccagccaagaatactccagagctaactacatacgcctggtaaccagcagaacgcctggccaggcctacccgaggttccctcactctatgcgtcgggtacccacgacgggcccacgtcggcacgtcccagacgtaggttcaggtcggacgtaggtcgggtcgtgggaactaggtacttcacttctactatcgtaatacgcgtagacgtcgggacgtccgtaggaacgttacgtttcgacgtagttcgtaattacgtgtacagtactagtagtagtaacgttcctacgttcgttcggtaccggttaccggaaccgtacgggtaaccgtaaggtaacgaaacgtacggaaaaccgtacgttaggtacggacgtacgacctaaccgtacgtcgttacg

SEQ ID NO: 146355 - DNA, 805 bp, Homo sapiens
  misc_feature: GYAE6OF02JSNIL.21.4.A04.1.454.CMB.1.raw
  modified_base (592)..(592): a, c, t, g, unknown or other
  misc_feature (592)..(592): n is a, c, g, or t
tcagtcgtcgctcgcacgaccggtgctcgatttagagtagtgatcagggagagctgctcagttaggacccagagggaaccatggaaacccagcgcagcttctcttcctcctgctactctggctcccaggctcagaaaccaccggagaaattgtagttgacgcagtctccaggccacccgtgtcctttgtcctccgaggggaaagacgccaaccctctcctgcagcctccagcccaagaatactccagcgctaacgtacattacgcctaggtacccaggtcacgaagccgtggcccaggcctacccgaggtttcccacgatccgttaatcggccttcggggtacccccaaggtaccgggcctaaccgtgggccaacttccccgaagaccgtaggtttccaacggttgggaccaggggtttcgggtccgtttaggggaactacggtaccttttacccgacttaccggtttcaacgttccgtaaagtttacggtaacccgaacggttaacccgttgggggaacttaccccgggtaagttaaagttaccggtttttccggaacgtttaaaccgggtttgttaaacgttttaaccgnggttaaccgaaggttaccggtaacgtttaacggttacggggttaaaacgtttcccgtaacccgtttaacgttggggttacccgtttaccggggaaccgtaaacggggttaaacccgtaaaggggttaaaggttaaaccgttaaaccggaaaacgttaaaccccggttgggtcggtttaaccggagacccgtaacccgtattacccggtttcgg

SEQ ID NO: 146356 - DNA, 594 bp, Homo sapiens
  misc_feature: GYAE6OF02HGFNN.21.4.A04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctaactacatacgcctggtaccagcagaagcctggccaggctcccaggttccncatctatcgcgtcgggtcccacgacgggccaagtggcatcccgagacaggttcaggtcggctaggtcgggtcgtaggggactaaggtacttcgaacgtctcgatcattagcagtacgtggacgtccgtagaacgtatttcggactaggttcgttaacgttacttgtacgagtacgtaagttagtaggtaacttccgaccttcgttcgttaccggttcggtaccgaacgggtaccgtaaagggtaacgaaagtacggaaaaccgtacgtaggtacggtacgtacgaccgtaccgtatcgttacg

SEQ ID NO: 146357 - DNA, 780 bp, Homo sapiens
  misc_feature: GYAE6OF02FWB6S.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccaccctctcctgcagctccagccagaatatccagacgctactacatacgcctggtaccagcagaagcctggccaggcctcccaggttcctacatctatcgcttcgggtcccacgacggggccacgttgggacctactccccaaggtacctagggtttccaaggttcgggacctagggtcggggttccgttagggggaacctaagggtacctttaccgacttcctacgtaacttcgttaacgtttacgacgtaacggtacgttagggacggtacccgttaggtaaagtaccgttttccggacgttaacgggtttacgttaacgttttaacgttacggtacctacgggtacctaaaggtttaacgtttaccggggttaaaaggttttaccccgtaacccgttttaccggtttacggtttacccgggtttaccggggtaacccgggtaacgggggtaacccggtaaaagggggttaaacggtaaaaccggttaaacgggtaaaaacccgggttaaccgttaacggggttacgggtacccgttacgggtaaccctaacccgtttacgttaccgtttaccgg

SEQ ID NO: 146358 - DNA, 636 bp, Homo sapiens
  misc_feature: GYAE6OF02IF4M5.21.4.A04.1.454.CMB.1.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctggtggagtcgnggggganacgttggtccagccgtggagggtccctggagacctctccgtgcagccctctgactattccgaccttcagtcgaccacaactagtcggactcgggtcccgccgaggcctccggaggggacgggctagggaggtcggggtacggccgtaatacgaaaggaacncgtaanagtacagtaacaggaatacgcgcgtcgtagtacggaaagtacgtacacctagtactacgaagtagagtgtaactanaaacgaactactacgtatagtacngtacaaatacgaaacctacgaacccgtacggaaaaaccgtagggaacccgtacgggaaccgtacgttaagttacgtttaggttacggaaacggtaacgaaaaaggtgtaggtacgtagggttacggacggtttaaggacttaggtaccgtaacgg

SEQ ID NO: 146359 - DNA, 690 bp, Homo sapiens
  misc_feature: GYAE6OF02FKD1J.21.4.A04.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagcgcccaccctctcctgcagctccagccagaatactccagagctactacatacgcctggtaccagcagaacgcctggcccaggcctcccgaggttccctnactctatgctcgggtcccacgacgggccacgtggacactcccgagacctacggttcgaggtggacgaggttcggggtcgtggggaacctaggtacctttaccaccgtttccgctacttactaattacgactaaggtaacgttcgggaacgtccgtaaggtaaacgtacgttttaccggacgtaaggtttacgtttaactttaacgttcggtacgtacggtacgtaaggttacggtacggttaacgtttccgtaacccgtttcgttacggtttaccggttaccgggacccgtaaacggggtaaccgtaaaggggtaacgtaaacgttaacggtaaaaccggtacgttagggtaccggtacgttacggacctaaccgtacgttacgttacgg

SEQ ID NO: 146360 - DNA, 701 bp, Homo sapiens
  misc_feature: GYAE6OF02IY66V.21.4.A04.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaanagccaccctctcctgcagctccagccagaatactccaganctactacatagcctggtaccagcagaagcctagccaggctccaggttcctcatctatcgctcgggtacccagacgggccacgtggaccacttcccgaagaccgtacggtttccaaggttcgggaccgtaggttcggggttacctagggggaacctaggtaacccttttaccgaacgttaccctacgtaacttacgtaaacgtttaacgacgtaacggtaaccgtacgggtaaccgtaccgttaggtaaacggttagttttaccggacgttaagggtttacgttaactttaacgttacgtacgacgtacgtaggttacgtaggtaacgtttaccgtaccgttaccgttacggttaccgttaccggaccggtaacgggaccgtaaagggtaacggtaaagtaacggtaaacgtaaccggttaggttacggtacgtacggtaccgtaaccgtacgttaccgttacg

SEQ ID NO: 146361 - DNA, 565 bp, Homo sapiens
  misc_feature: GYAE6OF02GGJ2S.21.4.A04.1.454.CMB.1.raw
  modified_base (200)..(200): a, c, t, g, unknown or other
  misc_feature (200)..(200): n is a, c, g, or t
  modified_base (422)..(422): a, c, t, g, unknown or other
  misc_feature (422)..(422): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatagcctggtaccagcagaagcctggccaggcctcccaggttccctcatctatgcctcggggtccccacgacggggcccacgtgggcacgtcccagaccaggttcaggtggcaggtcgggtctggggacaggactttcgaattctcatcattacgcagactggacgcctagaagtntttcgctagttgtattactgtacagtctagttagtaggtaacgttcacgttcgtggttccgttacgaccgtaagggaccctaagggtaacgtaaagtacggaaacgtacgttggtacggacttcggacctacctatcgttacg

SEQ ID NO: 146362 - DNA, 650 bp, Homo sapiens
  misc_feature: GYAE6OF02F409X.21.4.A04.1.454.CMB.1.raw
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaatttgtgttgacgcagtctccaggcaccctgtctttgtctccgaggggaaancgccacctctcctgcagcctccagccagaatatccagagctaactanatacgcctggtaaccagcagaacgcctggcccaggcctccccgaggttccctagattctaatcgcgttcgggtccccacgacgggccacgtggaccactcccgagacctaggttccaggttcggacgtaggtcgggtctaggggacagtaccttcgactcgtcactctatagcgtagacgtaggacgtcctaggacgtacgtttcgacgtaggttcgttacttacgtagtactaagtcgtaagttagttaaggtaacgtttccacccgtttcttcggttaccgggttaccggtaaccgtaacggggtaaacccgtaaggggtaaacggtaaacgttaacggaaaaccgtacggttacggttacggtaccgtacggacctaacccgtacgttaccgttacgg

SEQ ID NO: 146363 - DNA, 729 bp, Homo sapiens
  misc_feature: GYAE6OF02HTHT4.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaaggggaaangcccaccctctcctgcagcctccagccagaatatccagacgctactacatacgcctaggtaccagcaagaacgcctgggccaacggccctacccgaggtttccctcaattctagtcggccgtcggtacccacggtaccggcctacgtcggacctaccgtacccgagaccgtaggttccgaggtcggacggtagggttcgggtacgtacggggactacgtaccttcgacttctacgtaatactacgttacgcgaacgtacgtaggacgtccgtaaggtaaacgtttcttaccggacgttaaggttagtttaacttacgtcggtacgaaggttacgtaaggttacggtacggttaaccttaccgtaccgtttacggttcgggttacccgtttaccgggaaccggtaacgggtaacccggtaaaagggtttaaaccggaaaacggttaaccggaaaaccggtttaacggtcggggtttaaccggtacgtaaccggtaaccccgtaacgttacggttaccttttaccgg

SEQ ID NO: 146364 - DNA, 747 bp, Homo sapiens
  misc_feature: GYAE6OF02FI74M.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctccgtgcacgtcctaccgacgaccgaagtaacttacctaccgaagacgtacctaacctaactagtacgtcccgttacggtaacccagaccgaagaaccgtccgtacggaccgtacggtccctacccgtacggttccctactactctagtcgtccggttaccgggtacccacggtacgggccctacggtcggacctaccgtacccgaaggtaccgttacggttaccggagggtcggaccggtaggggttcgggttcggtacgggaactaacggttaccttacctaccgttcctactactacgtagtacgacgacgtacggtagacgtacgtaggaacgttacgtttcgacgttagttacgttacttacgtcgtacgacgtacgtaggttagtacggttacgttacctacgttacgttccggtttaccggtacccgggtaacggtacgggtaaccggtaacggtaaagtaaacgtaaccgggtaaacgttacggtagggtaccggtacgtaccgacccgtaacgtacgttcgttaccg

SEQ ID NO: 146365 - DNA, 656 bp, Homo sapiens
  misc_feature: GYAE6OF02GE6CK.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcagggggtagagcctgctcagttaggacccagagggaaccatggaaaccccagcgcagctctcttcctcctgctactctggctcccaggctcagaaaccacggagaaattgtgtgacgcagtctcaggcacctgtcttgtctccgagggtaangtccacctctccgtgcaggcctaccgagccaagaactactccagacgcctaacctacagtacgcctggtaccctacgcgaagaaccgcctcggaccaggtcctaccccgtagggttcccgtacaacgttcgtacgtcggtccgtcgggtacccacgacgggtccaacgtcggactacgtcccaaggtacctacggttcgaggtcggcgtagtgggtcgtgggactaggtacctttcgaccttctacgatccgtaattacgacgacgtacgtgggactccgtaggaagtacgttcgactaggttgtaacgttacgtgtacgtaaggctaaggttactacgggtaacgttaccgaaccgttctcggttaccggttaccgaaccggtaacggtaaccgtaagggtaaactaaagtacggaaaccgtaaagtggtacggccttacgactaaccgagttctacg

SEQ ID NO: 146366 - DNA, 734 bp, Homo sapiens
  misc_feature: GYAE6OF02G46GZ.21.4.A04.1.454.CMB.1.raw
  modified_base (204)..(204): a, c, t, g, unknown or other
  misc_feature (204)..(204): n is a, c, g, or t
  modified_base (276)..(276): a, c, t, g, unknown or other
  misc_feature (276)..(276): n is a, c, g, or t
  modified_base (601)..(601): a, c, t, g, unknown or other
  misc_feature (601)..(601): n is a, c, g, or t
tcagtcgtcgctcgcacgaccggtgctcgatttagagtagtgatcagggggagagctgctcacgttaggacccagagggaaccatgggaaaccccagcgcgagcttctcttcctcctgctactctggctcccaggctcagaaaccaccggagaaattgtgttgacgcagtctccaggcaccctgtctttgtctccgaggggaancgccaccctctcctgcgagctccagccagaatactccagacgcctactacatacgcctggtaccagcagacncctaggcctaggcctcccaggttccctacgactctacgtcggccgtcggtaccccacgacgggccacgtcggactacgtacccgaggtaacgtacggttaccaaggttggaccgtaagggttcgggtccggttaacggggaacctaaggttaccgttacctaaccgttccgtaacctacgtttacctaaaggttacgggaccttaaggtaccgtacgggtaaccgtccgaaggtaaacggtcgtttaccggacgttaacgttaacggtaactttaacggtcttaacgacgtaaccgtaaggttaagttaccggaaacgtttcccnccgtttaacggtccggtttaccgttacggggaacccgtaacggggaacccgttaagggttaaaccgtaaacgtaacggtaacccgttaagtcgggtacggttaccaggacccctaagttaccgttaccttagg

SEQ ID NO: 146367 - DNA, 582 bp, Homo sapiens
  misc_feature: GYAE6OF02H2PUL.21.4.A04.1.454.CMB.1.raw
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccaccctctcctgcagctccagccagaatatccagagctactacatagcctggtaccagcagaagcctggccaggctcccaggttccncatctatgctgggtccccagagggcccacgtggccactcccgagacaggttcagtggcaggtgggtctgggacagtacttcgactcncatcattagctagctggancctgaagtacttcgntagttgtaacttacgngtactagcgtagttatcgggtaaactttcaccgttctcggttaccggttacgggacccgtaaggggtccctaaaaggggttagaaaacggttacggtaaaaccggtaacgtttgggtaacgggttaccgtacgacccgtaacctgttacccgttacgg

SEQ ID NO: 146368 - DNA, 682 bp, Homo sapiens
  misc_feature: GYAE6OF02J2S58.21.4.A04.1.454.CMB.1.raw
  modified_base (529)..(529): a, c, t, g, unknown or other
  misc_feature (529)..(529): n is a, c, g, or t
  modified_base (567)..(567): a, c, t, g, unknown or other
  misc_feature (567)..(567): n is a, c, g, or t
  modified_base (579)..(579): a, c, t, g, unknown or other
  misc_feature (579)..(579): n is a, c, g, or t
  modified_base (645)..(645): a, c, t, g, unknown or other
  misc_feature (645)..(645): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagctgggttttcctgttgttatttacaaggtgtccagtgtgaggtgcagctggtggagtcgtgggggagacgttggtccagccgtgggacgggtcccctggagactctcctgtgcagcctctgcattccaccttcgagtcgaccacaactagtggacgtcggtcccgccaggccgtaccgaggggaacggggcgtgggaggtcggggtccggaccggttaattaaccgaaaggaacgtacgtaaacgagttacgagtaacgaagaaacgtaccggcgtacgttcgtaggtaaggaaagggtacgttccgaacctagtcctacgaaaggctaagtaacgtattacgaaaaacggtccttacgaacgtttcgtacgtctaaccgganaaagtaccgaactacgaccctaaagggaaaaaccccgngggtaaaccccncgggttaaccgttagttaacttcggtttagggtaaccggttaagaaagtaaaacggtggttaaggngttaacgggtgggttaacgggtagtcgttagggtaac

SEQ ID NO: 146369 - DNA, 624 bp, Homo sapiens
  misc_feature: GYAE6OF02JPJAJ.21.4.A04.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (522)..(522): a, c, t, g, unknown or other
  misc_feature (522)..(522): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtgggggagacttggtccagcccgtgggacgggtcccctggacgactcttccgtgtgcgagtccctntcgctacgttcaccttnagtgaaccacaacntggactggtccgcaggcctcgagggaggtcnggagtgggtcgaccgtatacgaaggaagactaacgacgttacagtacgaagtaacgtacggcgtcggtctagggtaacgtaaagggacgttaccaacgtatcctacgaagtaagctaagacttaacaaagtactacgatagtatcgtaagacaaagtagaaccgtacgtacctaagggaaaacccgnggtaaaccgacggtaccgttagttactttaaggtcggttaaggtaacgaacgtaaaagggcgttaagggactttagggtaggtaggtacgtcgtagtaacgg

SEQ ID NO: 146370 - DNA, 841 bp, Homo sapiens
  misc_feature: GYAE6OF02HSQYK.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagcgtggtggagtcgtgggggagtacgttggtccacgccgtgggacgggtccctgacgtactcctccgtgtcgcagtccctctgcctattccaccttcagtcgaaccacaacagtcggaccgtcgggtcccgccgaggcctaccggaaggggaacggggccgtaggggaggtcgggggtccggtacccgttaagttaaccggaaaagggaaacgtaccgttaaaacgtacggtttaacgaaacgggttaaaccgaaacgggtaaaacgtaaccgggggtacccgttaccgggttacccggttaaaggggttaacggggtaaaaaacgggggttaacgggttttaacccccaaaccgttaaaccgtttacccgttaaccggaaaagggttacgtaaacgttaggtaaaccgttttaaaccgaaaaaacggttaaccctttaccgaaaccgtttagggttaaacttacgttaacggaactaaaaacgtacggaaaccgtaacggtacccgttaaaacggaaaacccgggacgggtaacccgtaaccggggtacctttaggttaacttttgtttaaagggtcgggttaaacaaacggtaaaaggtcgggtaggtaagttgggttaagggtcggtaagtcgttagtaacg

SEQ ID NO: 146371 - DNA, 781 bp, Homo sapiens
  misc_feature: GYAE6OF02II3QF.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatactccagacgctactacatacgcctggtaaccagcaacgaacgcctggccaggcctacccgaggttccctacgactccgtatcgacgttcgggtaccccacgacgggcccacgtcggccacgtccccgaagaccgtaaggtttccaaggtcggccgtagggttcggggtactggggaactacggtaaccttttccaccgttcccttacgtaacttaccgtaaacgtttaacggaccgtaacggtaaccgttacgggaacgtacccgttaaggtaaaacggttacgtttttacccgggtaacgtaacggtttacggtttaacgttttaaccgttacggttacgttaacgggtaccgggttaagttacgggtaaacgtttaccgttaacccgtttaccggtttcggtttacccggtttaccgggaacccgggtaaacggggtacccgttaaaaggggtaacggtaaaacggttaaccggtaaaaccggttaaacggttacgggtaacggtaccttacggtacccaaccgttacgttaccgttcgtttacccg

SEQ ID NO: 146372 - DNA, 731 bp, Homo sapiens
  misc_feature: GYAE6OF02H4THN.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggccacctgtctttgtctcgaggggaaangccaccctctcctgcagctccagccagaatatccaagagctactacatacgctggtaccagcagaacgccgtggaccaggcctcccgtacggttcctctattctatcgcgtcggtaccacgacgggccacgtcggcactccgagacgtacggttcaggtcggcgtagggtcgggtcgtaggggactaacgtaccttccgtacctcgttacgtacttaccgtagtttacggacgtaaggtaccgtagggtacgtacccgttaaggtaagttacgttttccggacgttaacggttacgtttaactttacgttcggtaaccgtacggtaccgtaaaggtttacgttaacgggttaaaccgtttacccgttaaccgttccggttacggttaacccgggtttaccgggaacccggtaaacggggttaacccggttaaaggggtaacggtaaaaccggttaagggaaaacccgttaacggttacgggtacggtaccgttaaccggtacccgtaaaccgttacgttaccgtttaaccgg

SEQ ID NO: 146373 - DNA, 580 bp, Homo sapiens
  misc_feature: GYAE6OF02GSSX9.21.4.A04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctactacatacgcctggtaccagcaagaagcctggccaggcctcccgaggttccncatctatgcgtcgggtcccagacgggccacgtggccactcccgagaccaggttcagtggcaggtgggtcgtgggacagtacttcactctcatctattagcagacgtggacgtccgtagaacgtattcgcgtagttgtattacgtgtacagctagtagtaggtaacgttctaccgttcgttcggttccgttacggaccgtaacgggaccgtaaagggtaacgtaaagttaacggaaaaccgtaacgttggtacggtcgttacggaccctaccgtacgttcgttacg

SEQ ID NO: 146374 - DNA, 616 bp, Homo sapiens
  misc_feature: GYAE6OF02HWU8Q.21.4.A04.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaanagccaccctctccngcagctccagccaagaactatccagagctactacatagcctaggtaccagcagaagcctggccaggcctcccgaggttccctcatctagtcgcgtcggtcccacgacgggccacgtggccatcccgagactaggttcaggtcggcagggtgggtctagggactaacgtacttcgaccttcgtcatctattacgacagacgtggacgtccgtagtaacgtacttcggactaggttacgttaattacgtgttacagtactaaggttagtacggtaacgtttccgtaccgtttcgttacggttccggtttaccgggtaccgaacgggtaccgtaaagggtaacggaaagttaacggaaacggtaacgttcggtacgggtactacggacctaaccgtagtcgttacg

SEQ ID NO: 146375 - DNA, 554 bp, Homo sapiens
  misc_feature: GYAE6OF02ID5GJ.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (342)..(342): a, c, t, g, unknown or other
  misc_feature (342)..(342): n is a, c, g, or t
  modified_base (385)..(385): a, c, t, g, unknown or other
  misc_feature (385)..(385): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctcaggggaaagngccaccctntcctgcagctccagccagaatatccagagctactacatagcctggtaccagcagagcctggccaggctcccaggttctcatctatgctgggtcccanacgggccacgtggcatcccagactaggttcagtggcngtggtctgggacagacttcactctcatcattagcagactggancctagaagtatttcgctagtgttattactgtacagctaggttatagggtaacgtttcaccttcgttaggtccgtttacgggaccctaaggggtaccctaaagggtaacgtaaagtaacggaaaccgtaacgttggtacggtcgttacggacctaacgtacgtcttacgg

SEQ ID NO: 146376 - DNA, 635 bp, Homo sapiens
  misc_feature: GYAE6OF02I1JA5.21.4.A04.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (443)..(443): a, c, t, g, unknown or other
  misc_feature (443)..(443): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanagccaccctntcctgcagctccagccagaatactccagagctactacgatacgcctggtaaccagcagaacgcctaggcccaggctcccaggttcctnatctatcgctcgggtcccacgtaggggcccacgtgggacaactccccgagtaccgtagggttaccaggttcggctaggtggtctgggacagtcttcacgtctcataccgattagacgagtacgtacggacgtcctaggtaagtntttacgctacggttagttatttaccttagggtcctaaggtctaaggtttagtacgggttaacgttcccaacgtttccgttacgggttcgtttaccggacccgtagggttaaccgtaagggtaaaggtaaacttaaggaaaccggtaacgttaggtaacggtcgtacggtaaccaccgtacttacgtttaccg

SEQ ID NO: 146377 - DNA, 554 bp, Homo sapiens
  misc_feature: GYAE6OF02JEYXS.21.4.A04.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctctcctgcagctccagccagaatntccagcgctactacatacgcctaggtaccagcagaacgcctggcccaggcctcccgaggtttcccnatctatgcgtcggtcccacgcggccacgtgctacgtcccagactaggttcaggtcgctagggtcggtcgtgggacacgtcttcacttctacgatcagttcgcagctaggcgtcgtagatattcgctaggtntattctgtacngctagtagtagtacttccacttcgtacgttccggttacgaccgtacgggacgtaaggtaacgtaacgtaaggaaccgtagtaggtcgactacgaccctagttacctcgttacg

SEQ ID NO: 146378 - DNA, 846 bp, Homo sapiens
  misc_feature: GYAE6OF02H3SA2.21.4.A04.1.454.CMB.1.raw
  modified_base (235)..(235): a, c, t, g, unknown or other
  misc_feature (235)..(235): n is a, c, g, or t
tcagtcgtcgctcgcacgaccggtgctcgatttagagtagtgatcagggggaggagctgctcagttacggacccacgaggggaacctatgggaaacccctagcgtcgagcttctcgttcctcctagctaactctacggctccccagggctcgtaggaaacccaccgggagtaaattgttgtttgacggctaagtttaactccgaggcacccgtgtcgtttgctcgaggggaaagngccacccgtgtaccgtgtacagctccaggccagaatactccagagcctactacactagcctacggtaccagtcagaacgcctggccaggcctccgacgggtttcccacagttccgtacggtggccgtcggggtacccacggtacgggcctaacgtcgggcaacgtcccgaaggacgtaggttaccgaggttcggacgtagggtttcgggttcgtacgggaccgtacggtaccgtttaccggacccgttacctacctaacttccgtaaacgttacgggaaccgtaacgtaccggtttacgggaacggtaccgtaacgggtaaacgttacgttttaccggaccgtttaaggtttacgtttaaacgtttacgtacggtaccgtaaggtacggttaaggtaacggttacgggtaaacgtttacccgtaacccgttcggtttacggtttaacccgggtttaccgggaacccgggttaaacgggggtaaccccgtaaaggggtttaaacgtaaaacggttaacgggtaaaaacccggttaacggttacccgggttacccgggtaaccggttaccggtaacccctaaaccggtttaccggttttaccgtttaaccggg

SEQ ID NO: 146379 - DNA, 823 bp, Homo sapiens
  misc_feature: GYAE6OF02FF69E.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccaggccaccctgtctttgctaccgagggaacncgcccaccgttctccgtgcacgccttaccaggcccaagtaactactccgaaggtactccttaaccgtacaagttaccggacccgttagggtaacccaggaccgaacggtaaccgtccccgtacgggaccccaacgggtccccttaccccggtaagtttcccctagtacttacctaagtccggtaccgtaccggggtaccccaaggaccgggtaccctaacggtcggaccctaccgtacccgaaggtaccgtaggtttcgaggttcggacgttagggtcgggtacgtacggggaactacggtaccttccgaacgttccactaacgttacgtaagttacgacgtaaccgtacgttacggaaccttaccggttaacggaacgttaccgtttcggaacgtacggtttacgttaaccttacgttacgtaccgaacgttccgtaaggtttaccgttaacgggtttaaccttacccgttacccgttacggtttaccgggttaaccggttacccgggaaccgtaaccggggtaaacttaacggggttaaacgaaacggtaaacccggtaaaccggttaccgtaggtacccgtacgtaccggacccttacgttaccgtttccgtaaccg

SEQ ID NO: 146380 - DNA, 655 bp, Homo sapiens
  misc_feature: GYAE6OF02IJYIP.21.4.A04.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattcgtgttgacgcagtctccaggcaccctgtctttgtctccaggggaaagngccaccctntcctgccagctccagtccagaactatccaagacgctacacagtacgcctggtacccagctaggaacgcctggcccaaggtctccccaacggtttcccncaactcctagtcggtcgttcgggtcccacgacgggcccaacgtggccactcccaagaccaggtttccaaggtcggccaggtcgggtcgtgggaccaggacctttcgacgttctacgatacatttacgccaaggaccgtggacgtccgtaggaaagtacgtttacggactaggttcgttaagttacgtgtacagccgtaagttactagggtaactttccgaaccttcgtcggttaccggttccggaaccgtaacggggaaccgtaaagggtaacggtaaaacgttacggaaaaccgttaacgttaggtacggtacgtaggtaccgtaaccgtacgttacgttaccgg

SEQ ID NO: 146381 - DNA, 575 bp, Homo sapiens
  misc_feature: GYAE6OF02IAG6Z.21.4.A04.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaantccaccctctcctgcagctccagccagaatatccagagctactacatacgcctggtaccagcagaagcctggccaggctcccgtaggttccncatctatgccgtcggtcccacgacgggccacgtcggcactcccagactaggttccaggtggcgtaggtgggtcgtagggacagtacttcactctacagtcattacgcgtagtactggtacgcctagacgtacgtttcgactagttagttacttacgtgtcagtctagtacgtaggtacttcgaccttgtcggtaccgttcggaccgtaacggtaaccgtaaggtaagtaaacgtacggaaacgtacgtggtacggtaccgtacgtaccgaccttagtccttacg

SEQ ID NO: 146382 - DNA, 794 bp, Homo sapiens
  misc_feature: GYAE6OF02I5WOX.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaggtgtccagtgtgaggtgcagctggtggagtcgtgggggagacttggtccagcctgggacgggtccctgagacctctcctgtcgcagcctctgcattccaccttcagtcgaacccacaacagtacgggacgtcggggtacccgccgaagggcctaccggaagggggaacgggggctaggggtacgggttggggtccggacccggttaagttaaccgaaacgggaaaacgacgttaaaaccaggttaacgaaagtaacaaaggtaaacgtaaccggggcgtaccggttaccgtagggtaacgaaaaggggtaacggtttacccgaacctaagtacctaacgaaaggtaacgtagtacggtaaattaaaccgaaaaacgttaacttacgtaaccgttagtaacttcgtaacggaactaaaaggttcgaaaccgtacgtaacccgtaaagggaaaaaccccggtaagggaaccccgtacggggttaaccgttacggtttaacgtttaacgggttagggttaaacgggttaaacggaaaaccgttaaaaaggggtcggggttaagggtaaacggtttggggtttacggggtaacgggtttaacggtacggttccgggttaaacgg

SEQ ID NO: 146383 - DNA, 688 bp, Homo sapiens
  misc_feature: GYAE6OF02JLJE3.21.4.A04.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccaggggaaanagccacctctccngcagctccagccagaatactccagacgctactacatacgcctggtaccagacagaacgcctaggccaggcctcccgtaggtttcccnactctatcggccgttcgggaccccagaccgggtacccacgtcgggaccacgtacccagtaccgtacggttcaaggtcggacgtacgggttgggtccgtaggggactaaggtacctttccaacttcctacacttactaacgttacgacgtacgtacgtggacgtcctagaaggttctttcgacgtacgttagtactttacgtggtaccaggtactaaggttactaggggttaacgtttacctaaccgtttcgttacgggttccggttccgggaaaccggttacggggtaaaccggtaagggttaaacggaaactttaacgggtaaaaccggtacgtttaacggtcgggttaccggtacggtaaccccgtacgtacgttccggttaccg

SEQ ID NO: 146384 - DNA, 641 bp, Homo sapiens
  misc_feature: GYAE6OF02JAMIV.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccaggggaaagagccaccctctcctgcagctccagccagaatatccagagctaactacatagcctggtaccagcagaagcctggacccaggcctccctaggttccctcactctatgccgtgggtcccacgacgggccacgtggccagtcccgaagaccgtacggttcaaggtggcgaaggtcgggtctggggacacgtaccttcacttcgtacatcattacgcagacgtggacgtctagaagtacttcggactagttgttaacttacgtagttacaagtcgtaagttacgtagggtaacgtttccgtaccttacgttcggttaccgggttaccgggtaacccgtaacggggaacccgttaaagggttaaacgaaaacggttaacgggaaaaccggttaacgttaggtaaccgggtacgttaccggaccggtaaccctaggttacccttcgg

SEQ ID NO: 146385 - DNA, 613 bp, Homo sapiens
  misc_feature: GYAE6OF02IXQ8K.21.4.A04.1.454.CMB.1.raw
  modified_base (201)..(201): a, c, t, g, unknown or other
  misc_feature (201)..(201): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatactccagacgctactacatacgcctggtaccagcagaacgcctggcccaggcctcccgaggttccctacactctagtcgcgtcgggtacccacgacgggccacgtcggacacgtcccagactaggttcaggtggcaggtgggtctgggacngtacttcgactctcatcattagcagacgtggacgtccgtaggaacgtacgtttcgactaggttagttaacttacgtgtacgacggtactaggttagtacggtaacgttcctaaccgttcgttcggttaccggttaccggaccgtaacgggtaaccgtaaagggtaacgtaaaagtacggtaaaacgtaacgtcggtacggtcgtacggtacctaaccgtacgttcgttacg

SEQ ID NO: 146386 - DNA, 684 bp, Homo sapiens
  misc_feature: GYAE6OF02HXE23.21.4.A04.1.454.CMB.1.raw
  modified_base (465)..(465): a, c, t, g, unknown or other
  misc_feature (465)..(465): n is a, c, g, or t
  modified_base (542)..(542): a, c, t, g, unknown or other
  misc_feature (542)..(542): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttcgtcgtaggtattacaagtgtcagtgtgagtgcagctggtggagtcgtgggggatacgttggtccagccgtgggacgggtccctggaacgcttcgtcctgtcgaccagtccctgtgactatttcccaaccttcgaagtagaacccacaaaactgacggtaccgtcggggtccgaccgaggtccctaaccggaagggggtacggggtcgtaggggtacgggttcggggtccggtaccgtaaagttacgaaaacggtacgtactaaacggtaagttacgaagtaccgaaagtaacgtacggacgtcggttacngggtaacggaaaagggtacgttaccactactaccgtaagaacgtagtatcgtaactaaccgaaaagtactatacgtntaactcgtacgaataacgtacggaaactcggtaaccaacggtaaaaccgacggtaccgtacgggtaccgtatttacgttagttacggtacgaaaggtaagaaaggttagcggtagtagggtggtaaggtcgtacgtagtacg

SEQ ID NO: 146387 - DNA, 677 bp, Homo sapiens
  misc_feature: GYAE6OF02J15OI.21.4.A04.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaaagngccacctctcctgcagcctccagccagaatactccagagcctactacactaggcccttagggtaacccaggtccaaggtaacgccctgggcccacgggtcctcccgaggtttccccnattcctagtcgccgtcgggtccccagaccggggccacgtcggacctactcccgaggacctaggttccagggttcggactaggggttcgggtcgaggggacctaggtaccttcgaccttctacgtactactacgttacgacgaacgtaccgtagggacgtccgtaaggtaacgttacgtttcggacgttaacggttagttaccgtttacgtggtaccaggtctaggttacgttacggtaaccgttaccctacgttcgttacggttccggttacgggacccgtagggaacccgtaaggtaacgtaacgtaacggtaaacggtcgtagtacgggtacctaggacctaccgttagtaccgttcg

SEQ ID NO: 146388 - DNA, 586 bp, Homo sapiens
  misc_feature: GYAE6OF02I3UYZ.21.4.A04.1.454.CMB.1.raw
  modified_base (214)..(214): a, c, t, g, unknown or other
  misc_feature (214)..(214): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtctggggganacttggtccagcctggaggtccctgagactctcctgtgcagcctctgcattcaccttcagtgaccacaacatggacctgggtccgccaggctccgagggaaggggctgggagtcgggtcggccgtagttacgaaaggaacgctaacagttacagtacagaatacggcgcgtctagtagaaaggtagtcacatcanaagagatgattacgaaagtacnctactgtactctagactaaagtacgaacacgtaccgtaacgaaaaccggaggtaaccgacggtaccgtagtacgttagttaggttacggaagtaaaccgtaaaaggtacggtaaggtacgttagggtagggttagggtacgtacgtgttaaccgg

SEQ ID NO: 146389 - DNA, 704 bp, Homo sapiens
  misc_feature: GYAE6OF02GOL10.21.4.A04.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgctccgaggggaaangccaccctctcctgcagcctccagccagaatactccagacgactactacatacgcctaggtaccaggcaagaacgcctggaccaggcctacccgaggttccctnatctatcgcgtcgggtcccacgcgggacctagtcggaccacgtccccgaagaccgtaggtttaccacggttaggaccgtagggttcgggtccgtaggggaactacgtaaccgttaccaccgttcctacgtacttcgtaagtttacgaccgtacggtaaccgtacgggaacgtccgtaggtaaacgttcgtttaccggtactaaggttacgtttaactttacgttcgtacgtacgtagtaaggtacgtacggtaacgtttcctaccgttcgttacggtccggtttacggaccgtaacggggtaaccgtaagggttaaacggtaaacggtaacggaaaaccgttaacgtcgggttaaccggacgttaccggaacccgtaccgttacggttaccgtttccgg

SEQ ID NO: 146390 - DNA, 678 bp, Homo sapiens
  misc_feature: GYAE6OF02IVF5B.21.4.A04.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcacctgtctttgtctccaggggaagngccacctctcctgcagctccagccagaatatccagagctactacatacgcctggtaccagcaagaagcctggccaggcctccgagttccnatctatcgcgtcggcccagcgggccacgtcggctacgtcccagacgtacggttcaagggtcggcgtaagggttcgggtacgtaggggaactacggtacctttcaaccgttctacagttacctaagtttacgacgtaacggtacgtaggacgtaccgtaggtaaacgttacgtttccggacgtaaggttacgtttaacgtttaccgtacgtaccgtagtacgtaaggttagttacgggttaaacgtttccgtaccgtttcggttcggtttacccggttaccgggaacccggtaaacggggaaccgttaaacggggtaacgtaaaacgtacgggtaaaaccgtacggttaggtacggtacgttacggaccctaaccgttacgttccgttacg

SEQ ID NO: 146391 - DNA, 748 bp, Homo sapiens
  misc_feature: GYAE6OF02IY5B2.21.4.A04.1.454.CMB.1.raw
  modified_base (298)..(298): a, c, t, g, unknown or other
  misc_feature (298)..(298): n is a, c, g, or t
  modified_base (347)..(347): a, c, t, g, unknown or other
  misc_feature (347)..(347): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcgtggttcgtgtaggtacttacaaggtgtccagtgtgaggtgcagctggtggagtcgtgggggagtacgttgggccagcctgggagggtccctgagacctctcctggtcgcacgcctctgacctattccaaccttcagtcgaccacaacngtcggtacgtcgggtccacggagggcctaccggaagggggtaccggggntaggggtacggtacgggggtacccggtccgttaaagtaaccggaaaagggaaactacttaaaccgtagtttaaccgaggttaaaccaagggtaaaccgtacggggccggtaccgttacgttagggtaacggggaaaacggggttaaccgttaccgaaccgtaactacgtaacgtaaaggtaagaggttacgtaaacttaacgaaaacgtaaaccgttactaaccgttagttaacgtacccgttaagaccttaaagaacggtaaacgacggtaaccgtaaacggaaaaccggaacgggtaaccgaaccgggtacgttaagttacgttagttttagggacggttaaacaaaggtaaacgtaggtacggtattagggttcgggtaggtagtacggtagtaaccg

SEQ ID NO: 146392 - DNA, 558 bp, Homo sapiens
  misc_feature: GYAE6OF02HEFGK.21.4.A04.1.454.CMB.1.raw
  modified_base (200)..(200): a, c, t, g, unknown or other
  misc_feature (200)..(200): n is a, c, g, or t
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccagagctactacatagcctggtaccagcagaagcctggccaggcctcccaggttcctcatctatgctgggtccccagacgggccacgtggaccntcccagacaggttcagtggctaggtggtctgggacagacttcactctcatcattagcagtactggacgtcctagaacgtactttcgactagtntacttactgtacagcgtagtagtggtaactttcaaccttctagtccgttacggaccgaacgggtacctaagggtaagaaagttacggaaaaccgtaacgttggtacggtacgtacgtaccgtaacctagtcttacg

SEQ ID NO: 146393 - DNA, 697 bp, Homo sapiens
  misc_feature: GYAE6OF02G8DW6.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaactactccaagacgctaactacatacgcctggtaccagcaagaacgcctggaccaggtcctcccgtaggttccctcgacttctatcgccgtcgggtaccccacgacgggcctacgtggcctacgtacccgaagacgtacggttacgacggtcggactagggttcgggtacgtcggggaacaggtaccttcaccgttctactactactagttacgactaacggtacgtcgggaacgtcccgtaagtaacgttacgttttaccgacgttaaggttacgttaactttacggtagtaccgtaagtaccgtaagttacggttacggttaacgtttccgtaacccgtttcgttacggttaccggttccggaaccggtaacggggtaaccgtaaagggttaaagtaaacgttaacggtaaaaccgtacggttacggtacggtcgtaccgaccgtaaccgttacgttacttacgg

SEQ ID NO: 146394 - DNA, 648 bp, Homo sapiens
  misc_feature: GYAE6OF02IVZGT.21.4.A04.1.454.CMB.1.raw
  modified_base (200)..(200): a, c, t, g, unknown or other
  misc_feature (200)..(200): n is a, c, g, or t
  modified_base (393)..(393): a, c, t, g, unknown or other
  misc_feature (393)..(393): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangcccaccctctcctgcagcctccagcccagaatatccagacgctaactacatcgcctggtacccagccaaggaacgccgtggcccaggcctaccccgtaggtttccctcgaacttctaagtcggccgttcgggtaccccacgacgggccacgtggcactcccgagacctaggtccagttggctaggtgggtcngggacagtccttcacttcactactctacttagacagtacgtaggacgcgtagtaacgtactttacgctagttcttagttacgtcgtacgagacgtaaggtagtaggtaacgttcctaccgtttcgttcggttaccggttaccgggtaccggtaacgggtaaccgtaaacgggtaaacgtaaacggttaaacggaaaccgttaaggttacggttacgggtacggttaccgtaccgtaccgttacgttccgtttacg

SEQ ID NO: 146395 - DNA, 699 bp, Homo sapiens
  misc_feature: GYAE6OF02F57YD.21.4.A04.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagctccagccagatactccagacnctactacatacgcctggtaccagcaagaacgccgtggaccgacggtcctcccgaggttccctacgtacttctagtcgtcgtcgggtaccccaacgtacgggccacgtcggcctacgtcccagtaccgtacggttaccacggttcgggacgtacgggtcggggttacgtaggggacctaacgggtacctttaccgaccgttcctacgtactaccgtaagttacgcgtaacgtacggtcgggtacgtaccgtaaggtaacgtacgtttaccggacttaggttacgtttacttaacgtgtaaccgtacgtacgttaaggttacgtacgggttaacgttccgtaaccgttcgtcggtttaccggttaccggaaccggtacgggaaccgtaagggtaacgtaaacgtaacggtaaaccgtaggttacggtacggtccgtacggtacctacgtacgtacgttacg

SEQ ID NO: 146396 - DNA, 626 bp, Homo sapiens
  misc_feature: GYAE6OF02HXWJR.21.4.A04.1.454.CMB.1.raw
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctctcctgcagctccagccagaatatccagagctactacatagcctaggtaccagacagaacgcctaggccaggcctcccgaggtttcccnacttctagtcgccgtcgggtccccaacgacgggcccacgtcggcccctacccgagaccgtaggttcaggtcggctaggtcgggtctagggacacgtaccttcgaccttctacagttactagttacgacgacgtacgtgggacgtccgtaggaacgtacgtttacgacttaaggttgttaactttacgtgtacagacgtagttagtggtaacttccaccttcgtggttacccggttacggaccgtaagggtaccgaaggtaagaaacgttacgaaacggtacttagggtacgacgttcgaaccgtacctaacgttcgttacgttaccg

SEQ ID NO: 146397 - DNA, 556 bp, Homo sapiens
  misc_feature: GYAE6OF02INMAH.21.4.A04.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagcctaactacatagcctggtaccagcagaagcctggccaggctcccaggttcctnatctatgctcgggtcccagacgggccacgtggccatcccagacaggttcagtggcaggtcgggtctgggacagtacttcactctcatcattagcagactggagtctaggaagtagtttcgacgtagttcgttaactttacgtgtctagctagttatgggtaacttcgaccttgtcgttaccgttcggaccgtaagggaccgtaagggtaacgaaacgttagaaaccggtatggtacgacttggacctacgtacttcgttacg

SEQ ID NO: 146398 - DNA, 610 bp, Homo sapiens
  misc_feature: GYAE6OF02I84HA.21.4.A04.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtagtgatcagggggtaggagctgcctcagttaggacccagagggaaccatggaaaccccagcgcacgcttctcttcctcctgctactctggctcccaggctcacgaaaccaccggagaattgtgttgacgcagtctccaggccaccctgtctttgtctccaggggaangccacctctccngcagcctcagccagatacgtccaganctactanatagcctggtaccagcagaagcctggccaggctccgaggttccncactctatgctcggtccncgagggccactggcatcccagacgtacggttcaggtcggcaggtgggtctggggacagacttcgacgttcgactagtctacgttacgctaacgtacgtggacgtccgtagaacggtctttacggcctaggttacggtactttacgtcgttacgtaagtcttaagtagtcggtaacgttaccgtacgttcgtacgttaccgttaccgaccgtaacgggtaccgtaacggtaacggaaacgttacggtaaaccgtaacgttagggtaccgtacgtacggacctaccggtactcgtacccg

SEQ ID NO: 146399 - DNA, 720 bp, Homo sapiens
  misc_feature: GYAE6OF02HVKIS.21.4.A04.1.454.CMB.1.raw
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (357)..(357): a, c, t, g, unknown or other
  misc_feature (357)..(357): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgagtgcagctgggtggagtcgtgggggagacttggtccagcctgggagggtccctgacgactctcctggtgcagcctngcattcaccttnagtgacccanaacagtaggactgggtccncaggcctccgaggggagggctgggagtcgggtcggcgtagttacgaaggaanctaacagttacagtaacaagaacgtacggcgcgtcgtaggtaggaaaggtaacgggttcaaccgtagttaccacggtaaagacgtaattcggtaaactttaaccgaaaaaggtaaccttacgaaccgtttacggttaaacttccgtaacgtaaaccgtaaaaattacggaaacccgtaaagggtacccttaaaacgggaaaaacccggtacggggtaaacctaacccgggggtaccgtttaggtttaaacgtttacggttttaagggtaacgggttaaaacggtaaaccggtaaaaagggtcggttacgggaaaggttttcgggtagggggtttaacgggttacggtcggttacggttaacgg

SEQ ID NO: 146400 - DNA, 654 bp, Homo sapiens
  misc_feature: GYAE6OF02IW6K4.21.4.A04.1.454.CMB.1.raw
  modified_base (455)..(455): a, c, t, g, unknown or other
  misc_feature (455)..(455): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagacgccaccctctcctgcagctccagccagaatactccagacgctaactacatagcctaggtaaccagcaagaacgcctcggacccagggccctccccgaggtttccctcgacttctagtcggccgtcgggtccccacggcgggcctagtcggctactcccgaagtacgtacggttcaaggtcggactaggtgggtcgtgggactagaccttcactcgtcagtctagtcgcgagacgtggactcgtagaagttnttccgattagttgttacttacgtcgtacagtacgtagttacggtacggtaacgtttccaccgtttgttccgggttaccggtaccgggaacccgtaaggggtaaaccgtaaggggtaaaacgtaacggttaaacggtaaaaccggttaacggtcggtacggggtaccttacgacccgaaccgtttagttccggttaaccg

SEQ ID NO: 146401 - DNA, 537 bp, Homo sapiens
  misc_feature: GYAE6OF02HGRAG.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccanagggccatggcactcccagacaggttcagtggcaggtggtctgggactaggtacttcgacgttctcatcattagctagactggacnccttagaaagtntttcgactagttgttacttactgtcagctagtagtggtaattcactctgtacgttcgaccgtagggacctaaggtaagaactaggaaaacgtacgttaggtaggaccttagaccgtaactagtccgttacg

SEQ ID NO: 146402 - DNA, 724 bp, Homo sapiens
  misc_feature: GYAE6OF02JXZ0S.21.4.A04.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (325)..(325): a, c, t, g, unknown or other
  misc_feature (325)..(325): n is a, c, g, or t
tcagtcgtcgctcgcacgaccggtgctcgatttagagtagtgatcagggaggagctgctcagttaggacccagagggaaccataggaaccccagcgcagcttctcttcctcctgctactctggctcccaggctcagaaccaccggagaaattgtgttgacgcagtctcaggcacctgtcttgtctccgaggggaanagccaccctctcctgccagctccggccaagaatatccgagngacctaactaacntacgcctcggtaccagcagaacgcctggcccaggcctccctaggttcctccatcctatcgcgtcggtcccaccgngggccctacgtggacctctacccgagactagggttccaggtcggactacggttgggttcgaggggactaagggtaaccctttcaccgtccctacgtaacccagtaccgtaacccgacgtacgtaccggacggtacccgtacggtaacgttacgttttacggaccgttaaggtttacgtttaacgttacgttacggtacgtacggtacgttaacgttaacggttacgggttacgtacccgttaccgacccgttaacccttacgtttaccgtaaccgtttaccggttttaccgggacggtaaccggggtaacccggtaacgggttaacggtaaacttaacggtaaacccgttaaccggttacggtacgtaccggttaccggacccttacccggtattaccg

SEQ ID NO: 146403 - DNA, 643 bp, Homo sapiens
  misc_feature: GYAE6OF02G62JJ.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcagggaangccacctctctgcagctccagccagaactactaccagacgctaactacatagcctggtaccagcagaacgcctggccaggtcctcccgaaggttcctacgatcttatacgctcgggtacccaacgacggggaccacgtcggctaactccctagaccgtaggttcaaggttcggacgtaggttcgggtactaggggactacgtacttacaccgttctacacgttctaacgttagactaaggtacgttaggacgtaccgttaaggaacgttacgtttcgactaggttacgttattaccgttgtacgtacgacgtagttaagttcggtaacgtttccaacgttcgtacggttccgttacgaaccggtaacggtaccggtaaagggtaacgtaaacgtacggaaaccgtaagtacggtacgtacgtacgtacctacgtacgttccgttacg

SEQ ID NO: 146404 - DNA, 694 bp, Homo sapiens
  misc_feature: GYAE6OF02FHI0J.21.4.A04.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccagtggagtttgggctgagtctgggttttcctgttgttatttacaaggtgtccagtgtgaggtncagctggtggagtcgtgggggatacttcggtccagcctaggacggtcccngacgactctccgtgtacgcacgcctngctatcctaaccttgagtcgaacctacgaactgtaggactcgggtaccacgtaacggtcctacggaagggggacggttcgtacgggtaacggttcgggcccggttacgtaacgttaacgaaggtaaccgtcctaaacgtacgtttaaccgagttaaaccacggtaaacgttccgggaccgtactacggttacgtaaagggaaacggtaaccggttcaactacgttcaacgtaagacgtacttacgataacgaaacgtacctacgtattacggtactcgtagaactaacgtacgtaaaccgtacgtaacccgtaaacggtaaaccgaccgtaacggtacggttaccgtagttacttaacgtggtaaacggttaacgaaacgtaaaggtggtagtaggtaggtacggtggtacgtacgttgtaacg

SEQ ID NO: 146405 - DNA, 537 bp, Homo sapiens
  misc_feature: GYAE6OF02I2KTN.21.4.A04.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccaagaatactccagagctactacatagcctggtaccagcagaagcctggcccaggcctcccgaggtttccctcattctatcgcgtcgggtcccacgcgggccacgtggcactcccagaccaggttcagtggcaggtcgggtctggacagacttcactctcatcatgcagactggacgcgtagaagtntttcgngtagttgtacttactgtacagcaggttataggtacgttctaccgttctcgttacgtcggaccgagggaccgaagggtacaaagtgaaacgtacgtggtaggctacgacactagttctcg

SEQ ID NO: 146406 - DNA, 718 bp, Homo sapiens
  misc_feature: GYAE6OF02JTYQ6.21.4.A04.1.454.CMB.1.raw
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagtaaattgtagttgacgcagtctccgaggcaccctgtctttgctaccgaggggaaagngccaccctctcctgcagctccagccagaatactcccaggacnctaactacaagttacgccgttaggtaacccagtccaaggaacgtcccgtagggacccaagggtccctaccccgtaaccgggtttcccttacccgcttaaccggtacttcgtccggttacccggggttacccccaccgggaaacggggccccctaacggttgggaaccccacttcccccggaaagtaaccgcgggtttacaagggtccggcttaaggggttcgggtacgtggggaaccaacggtacttccaacggttctacatacgtactacgactcgtaacgtggtagacgtacgtaagtacgttcgtacgtagttcgtaattacgttagtccgtaagtcgtaagtagtacgtacgtcgttacctaagttcgtcgttacggaccgtacgtaccggtaaggtaacggtaaacgtacggaaacgttaaccgtagggtacggtaccgaggttacccacgttacgtacgttaccgg

SEQ ID NO: 146407 - DNA, 523 bp, Homo sapiens
  misc_feature: GYAE6OF02FZF23.21.4.A04.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggtccgcaggctccgagggaggggctggagtgggtcggccgtattacgaaggaagctaacagttacagtacagaatacggcgcgtctgtagaaaggaaggttcaccatctacaagagatgattacaaagtaactacactgtatctgacaaatgaacagacctagaaaccgagacacgcgtgtattatgtggaagaanaaagngtaggatggtggtggtagtcgtgtacg

SEQ ID NO: 146408 - DNA, 706 bp, Homo sapiens
  misc_feature: GYAE6OF02FWXRH.21.4.A04.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctccgtgcagcctccagccaagaatatccagagctactacatacgcctaggtaccagcaagaacgcctggcccaaggccttaccccgagggtttccctanacgttcctagtcggtccgttcgggtaccccaacgacggggacccaccgttgggaccaacgttccccgaaggaccgtaggtttccaaggtcggacgtagggttcggggtctaggggaactacggtacctttcgaaccgttccgactaccacgttacccaaccgtaagtaccgtcgggacgtaccgtaggtaaacgttagtttacgacgttacggttagtttaacgttacgttcgtacgtaggacttaaggttagtacggtaacgttacctacgttcgtacgttccggttaccggaccgtaacggtaaccgtaagggtaaacggttaaagtaacggaaaacgtacgttacgggtacggtaccgttacggaccgtacctaggtttaccgtgttacccg

SEQ ID NO: 146409 - DNA, 680 bp, Homo sapiens
  misc_feature: GYAE6OF02H6MWK.21.4.A04.1.454.CMB.1.raw
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcagggggagctctgagagcggagccccagcccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagcctgggacgggtccctggacgactctcctgtgcagcctctgccatttccacctttcagtcgaaccaccaacagtgggacttcggggtccgccgaggcctaccggaggggaacggggctgggaggtcgggtcggaccgtatacgaaggaagctaaacngttacagtacaggaatacggcgcgtctgtagaaaggtagtccacatcacaaganatagtaattacgaaaacgtactaccacgttacgttactacgtagaaccgaaagttacggaaaaccgaccggtaacccgtaaacgggaaaaaaccccgggttaacgggaaccccggaaaccggggttacccggttaaggtttaatttacgtttagggttaagggtaaaccgaaacgtaaaaagggtcggtaagggtacgttacgggttagggttacgggtaagtccgggttagtaaccgg

SEQ ID NO: 146410 - DNA, 567 bp, Homo sapiens
  misc_feature: GYAE6OF02HWSD5.21.4.A04.1.454.CMB.1.raw
  modified_base (451)..(451): a, c, t, g, unknown or other
  misc_feature (451)..(451): n is a, c, g, or t
  modified_base (519)..(519): a, c, t, g, unknown or other
  misc_feature (519)..(519): n is a, c, g, or t
  modified_base (561)..(561): a, c, t, g, unknown or other
  misc_feature (561)..(561): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagactttgggtccaggcccgtgggaggggtccctgagacttctcctgtgtagcctctgcattcaccttcagtcgaccacaacatggactcggggtcccgccgaggcctccgaggggaggggctgggagtgggtcggccgtattacgaaggaaagctaacagttacagtaacagaaatacggcgcgtctgtagaaaggaggttcacatctacgaagagatgattacaaaagtactnactgtatctgacaaatgaaacagacctaagaaaccgagacacggccgtagtattagttggtaggtaanaacgaaaggtgtaggattgggtagggtaggttaagcttaggngtaacg

SEQ ID NO: 146411 - DNA, 560 bp, Homo sapiens
  misc_feature: GYAE6OF02H7P03.21.4.A04.1.454.CMB.1.raw
  modified_base (216)..(216): a, c, t, g, unknown or other
  misc_feature (216)..(216): n is a, c, g, or t
  modified_base (434)..(434): a, c, t, g, unknown or other
  misc_feature (434)..(434): n is a, c, g, or t
  modified_base (496)..(496): a, c, t, g, unknown or other
  misc_feature (496)..(496): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtctggggganacttggtccagcctgggagggtccctgagactctcctgtgcagcctctgcattccaccttcagtcgaccacaacatcggactgggtccgcaggctccgagggagggctggagtgggtcgcgtatacaaggaagctaacagttacagtacagatacgcgcgtctgtagaaaggagttcaccatctacaagagatgattacaaagactcactgtatctanacaaatcgaacacgacctacgaaaaccgtaggaacaccggtaccgtagtacgttagttaggnggtaaggaaacaaaaggttacgagggttagtagggtagggttacggtagtccgttaggtaccgg

SEQ ID NO: 146412 - DNA, 643 bp, Homo sapiens
  misc_feature: GYAE6OF02HJCIV.21.4.A04.1.454.CMB.1.raw
  modified_base (216)..(216): a, c, t, g, unknown or other
  misc_feature (216)..(216): n is a, c, g, or t
  modified_base (609)..(609): a, c, t, g, unknown or other
  misc_feature (609)..(609): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctggagactctcctgtgcagcctctgcattcaccttcagtgaccacaacatcggacgtcgggtccgaccgaggcctaccggaggggaacggggcgtgggaggtggggtccggttacggtaacgttaacgaaagggaaacgtacctaaacgtaggttaacaaggtaaccgaaggtaaacgtaaccgggcgtaccggttcgtaggtaggaaaagggtacggtttaccaaccgtatacctacgaaagaagatagaattaacgaaacgtaactacaactagtactctacgaactaaacgtacaacgacgtaccgtaagaaaccgaggaccgacggtaccgttagtagttagttggtaggtaagaacgtaaaagngtaggagttggtaggttaggtacgtcgtggtacg

SEQ ID NO: 146413 - DNA, 602 bp, Homo sapiens
  misc_feature: GYAE6OF02GNKSY.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagagctactacatagcctggtaccagcagaagcctggccaggctcccagttcctcatctatgctggtcccacagggccactggcatcccagacaggttcagtgcaggtggtctagggacagtacttcactctcatcattagcagacgtggacgccgtagaacgtactttcgacgtaggttacgttaatttaacgtgttacgacggtactaacgttagttagggtaaacgtttccaaaccgtttcgttacggttcccggtttaccgggacccgtaacggggtaacccgtaaaggggtaacggtaaaacgttacgggaaaaccgtaacgttagggtacggtacgtacggtaccaacccgtattcgttacgg

SEQ ID NO: 146414 - DNA, 620 bp, Homo sapiens
  misc_feature: GYAE6OF02IG8CR.21.4.A04.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctacacagtacgcctggtaccagcagaagcctggccaggcctcccaggttccncatctatgcttcggcccagnggccagtggcactcccgagtacaggttcagtcgacagtcgggtctagggctaggtacttcactctcgactctatacgctaaggtactgggacnccgtaggaacgttacgttccggacgtaagttcgtttaacttcgtaggtaccgtagtaccgtaaggttagtacggtaaccgtttcctaccgttacgttcggttaccgttaccgggaccgtaacggggtaacccgtaaagggtaactaaaccggtacggtaaaacccggttagttacggttacggtacctcgggaccctaaccgtacggttccttacgg

SEQ ID NO: 146415 - DNA, 563 bp, Homo sapiens
  misc_feature: GYAE6OF02I8POH.21.4.A04.1.454.CMB.1.raw
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaagacgccaaccctctccctgcagctccagccaagaatatccagagctactaacatacgccgtggtaccagcagaacgccgtggcccaggcctcccaggttccncatctatgctcggtcccaacgacggccacgtggcctatcccagacctggttacagtggcaggtgggtctgggacagacttcaactctntatcatgacagacgtggacgcctagaagtacttcgatagttagttaattactgtacagtcagttatggtaaattcgacttgtcgttcgttacgacccgaaggtacctaaaggtaacgaaagtaacggaaacgtaagttacgggtagtacgtacgacctaactactgttacg

SEQ ID NO: 146416 - DNA, 695 bp, Homo sapiens
  misc_feature: GYAE6OF02FSW4P.21.4.A04.1.454.CMB.1.raw
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagctccagccagaatatccagngctactacatagcctggtaccagcagacnctggccaggctccaggttccncatctatgcgtcggtcccagacgggccacgtggccacgtcccaagaccgtaggttcaaggtggactaggttcggggtcgtaggggaacctaggtaccctttacgaccgttcgtactacgttactaacgttacgaccgtaaggtaccgttaggggtaccgtccgttaggtaaacgttcgttttaccggaccgttaacgtttacggttaacgtttaccgttaggtaccgtaacgttaccgttaaggttacgttagggttaaaccgtttacctaccgtttacgttacggtttccgttaccgggaacccgtaacggggtaaccgtaaacggttaaacgggaaacttaacggtaaaaccggttaccgttagggttaccggacgttaccggaactaccgttagtccgtttaacgg

SEQ ID NO: 146417 - DNA, 786 bp, Homo sapiens
  misc_feature: GYAE6OF02G3N3N.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgttctttgtctacgaaggggaaagcgcccaccctctcctgcacgctccagccaagaactactccagacgtcctactacatacgccttaggaccagcagaacgtcctaggccacggccctcccgtaaggttccctacaattctatcggcgttccgggtccccaacggacgggtacccacggttacggacctaaccgtaccccgaagggttaccgtaacggtttaccgaaggttcggaccggtacggggtttcggggtaaccggttggggtaaaccaacggtaccttttaccaaccgtttcctaacgtacttacaacgtttacgacgaacgtacgtacggtacgtccgtaaggtaacgtacgtttacggacgttaaggttacgttaactttaacggttcgtaaccgtacggttacgtaacggtttaacggtacgggttaacgtttacccgttaccgtttaccggttacggtttcccgggtaaccgggttaacccggtaaccggggtaaaccggtaaacgggtaaacggtaaaacggtaacggtaaaaccggtttaacgtacgggttacgtacccggttaacgacccgtaaccttacgtaccgtttaacg

SEQ ID NO: 146418 - DNA, 684 bp, Homo sapiens
  misc_feature: GYAE6OF02HK87E.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagacgctactacatacgcctggtaccagcagaagcctggccaggcctcccgaggttccctacacttctagtcgcgtcggtccccacgacgggccacgtggccacgtcccagtacgtacggttcaggttcggcgtaggttcgggtcgtaggggaactacggttacctttcgaccttccgttacctataccgtaaatttacgactaaacggtaccgtacgggtacgtacccgttaggaaacggttacgtttaccggacgttacggttacgtttaactttacgtcgttacgacgtacgtaaggttacgtaggtaaccgtttaccgaccgtttccgttcggttaccggtttacggacccgtaacgggtaaccgtaagggttaaacgaaacggttaacggaaaccgtaacggttcggtacggtacgtacggttacccgaacctacgttaccgttcg

SEQ ID NO: 146419 - DNA, 681 bp, Homo sapiens
  misc_feature: GYAE6OF02HNOR0.21.4.A04.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaaggggaaanactcccaccctctcctgcagctccagccagaatactccagacgcctaactacatacgccttaggtaccagcaaggaacgcccgtaggcccaggcctacccgacggttccnctatctagtcgcgttcgggtacccaggtacgggccctaagtcggcctacgtacccgagtacgacggtttacaggttacggctagggttcggtacgtagggactaaggtaccttaccgacttactctaagtctaagttacgacaagtaccgtagggacgtccgtagtaacgtcgtttcggacgttaagttcgttaattaccgtagtaccaggtacctaagggttagtacggtaacctttccgaaccgtttcgtacggttaccggttaccggaaccgtaacggggtaaccgttaagggtaaactaaacgttacggaaaaccgttaagttcgggtacggtctaacgacccgtaacttagttccgttaacgg

SEQ ID NO: 146420 - DNA, 709 bp, Homo sapiens
  misc_feature: GYAE6OF02HB11C.21.4.A04.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttccttgttgttattttacaaggtgtccagtgtgaggtgcagctggtggagtcgtgggggatacgttgggtccaggcccgttgggacgggttcccctaggacgtaccttcttacccgtggtcgcgacgtccctctgcctattccaccttcagtcaccaacaacngtcgggacgtcgggtccaccgaggtcctacggaggggacgggctagggaggttcggggtccggaccgttataaccggaaaggtaacgtactaaacgtagttaacacgtacgaaaggtaacgtaccgggtcgtacgtacgttaggtaaggtaaacgggtaagttcccaaccgtagttaccgtaacgaaggacgtataggtaacttaacgaaacgtactacgtacgttacgactctaaggacctaaagtaccgaaacgtaccgtaccgtaaacggaaaccggacggtaaccaccgggttacgttaagttacgtttaggttacggtacggtaaataacgggtaaaaggtggtaaggtacggttggtacgggttcggtaacggtcgtaggtacgg

SEQ ID NO: 146421 - DNA, 520 bp, Homo sapiens
  misc_feature: GYAE6OF02FUO89.21.4.A04.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (456)..(456): a, c, t, g, unknown or other
  misc_feature (456)..(456): n is a, c, g, or t
  modified_base (517)..(517): a, c, t, g, unknown or other
  misc_feature (517)..(517): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagagtctactacatagcctggtaccagcagaagcctggccaggctcccaggttcctcatctatgctgggtccccagagggccacgtggcaagtcccagacctaggttcaggtggcaggtgggtctgggacagacttcactctnatcattacgcagactggacgtccgtagaagtatttcgctagttgtattactgtcagtctagtataggtagttcacctntcgtcgtcgaccgaggaccaaggtaagaagtacgaaacgtacgtagtagctagcactactntcg

SEQ ID NO: 146422 - DNA, 643 bp, Homo sapiens
  misc_feature: GYAE6OF02GMBKT.21.4.A04.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagagtagtgatcaggggagctctgagagcggagccccagccccagaattcccaggtgttttcatttggtgatcagcactgaacgcagaggactcaccatggagtttgggctgagctgggttttccttgttgttattttacaaggtgtccagtgtgaggtgcagctggtggagtcgtgggggagacgttggtccagccgtggagggtccctgagactctcctgtgcagcctctgctattcaccttcagtcgaccacaacatcggacgtgggtcccgccgaggcctccgaggggaaggggcgtgggaggtcggggtcggccgtaagttacgaaaggaaacgactaacgagttaacagtacaagaagtacggcgtcgtcngtaggaaagggtacgtccaaccatctacgaaagagatgaattacaaaagtactcaacttgtaactctagaacaaagtacgaaacgtacgaacccgtaaaggaaaaacccggtagggaaaccgtaccgggtccgtttagtaacgtttagtttggtaagggttaaacgaaaggtaaaaaggtcggttaagggtaacgttaggggttacgggttagggtaacgtcgttaggtaccg

SEQ ID NO: 146423 - DNA, 937 bp, Homo sapiens
  misc_feature: GYAE6OF02HZ8AK.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatagaaaccccagcgcagcttctcttcctcctgctactctggcctcccaggctcagaaaccaccggagaaattgtgttgacgcagtctccaggccaccctgtctttgctcgaggggaancgcccaccctctcctgcagcctccagccaagaacttactcccaaggacgtacctaactaaccagtacgcccgtacggtaccagaccgaaggaacgtccgtgggacccctaggtcccttccccggaacggtttccctacgtaacttccgttagtcggtcccgttacgggggtacccccaacgggaccggggtacccctaaccggttacgggccccttaaacccggttacccccggtaaaagggtacccggttaacggggttttaccccgaaggggtttccggggaaccgttaacggggggtttcgggggttaccccgtaaaggggggtaacccgttaacccgggttaaaccctttttacccgaaccccggttttccgtttaaccgtaaccgtttaccggtaaaccggttttaacgggaacccggtaaacgggttacccggttacggggtaaccttaccggtaagggtaaaccgtttaccgttttaccgggaacgtttacggtttaacggttaacttttaccggtacggttaccgtaaggttaccgttaaggtttaacgtaacggggttaaacctttaccgtacccgtttaggttcccgggtttaacccggtacgggtaacccggtaacgggtaaacccggttaaagggtaaaccggttaaacgtaaacggtaacccggtaacgttagggtcggtaacccgtacggtaaccctaaccggttacctttcggttaacccg

SEQ ID NO: 146424 - DNA, 561 bp, Homo sapiens
  misc_feature: GYAE6OF02I4W7E.21.4.A04.1.454.CMB.1.raw
  modified_base (292)..(292): a, c, t, g, unknown or other
  misc_feature (292)..(292): n is a, c, g, or t
  modified_base (358)..(358): a, c, t, g, unknown or other
  misc_feature (358)..(358): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtctgggggagacttgggtcccaggcctggagggtcccctgagactctcctgtgcagcctctgcattccaccttcagtgacccacaacntggactgggtccgccaggcctcgaggggagggctgggagtgggtcgcgtatacgaaggaagctaangttacagtacagaatacggcgcgtctgtagaaaggtagttccaaccgtatcctacaaagtagatagaattacaaaagtaactcgacttgtaactctagacaaagtgaacngacctaagaaaccgngaccacggccgtagtacttagttggtaggtaagaacgtaaaaggtcgtaggagtggtaggtggtaacgtcgtggtacg

SEQ ID NO: 146425 - DNA, 608 bp, Homo sapiens
  misc_feature: GYAE6OF02GY74J.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagcgccaccctctcctgcagctccagccagaatatccagagctactacatacgcctggtaccagcagaagcctggccaggctcccgaggttcctcatctatcggctcgggtcccagcgggccagtcggctactcccgagacctaggttcaggtggctaggtcgggtctgggactagacttcacttctcatctattgctagacgtggacgtcgtaggtaacgtacgtttcggtaagttgttaagttacgtcgtacgtagtacgtaaggtagttagggtaacgtttcgtaccttcgttcggttaccggttaccggtaccggtaacggggtacctaagggttaaacgaaagtaacggaaacgtaaccggttaggtacggtacgtacggaccctacgtacgttcgtacgttcc

SEQ ID NO: 146426 - DNA, 718 bp, Homo sapiens
  misc_feature: GYAE6OF02F5ZIC.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangccaccctctcctgcagcctccagccagaatactccagagctactacatacgcctggtaccagcagaacgcctggccaggcctcccgaggttcctcatctatggctcgggtcccacgcgggccacgtggccactcccgaagtaccgtacggttacaggttcggacgtagggttgggtacgtaggggactaggtaccttccacgttcctactatacgtaattacgacgaagtacgtagggtacgtccgttaggaacgtaccgttttcggaacgtagtttacgttaactttacgtcggtactaaggtaccgttaaggttaggttaacggtaacgtttacccgtaaccgtttcggttaccgggtttaccggttaccgggtacccgggtaacgggttaacccggtaaaaggggtttaaacggtaaaaaggttaccgggtaaaaaccggttaaacggtttacgggttaacggtacccgggtttaccggaacccgtaacccggtttacgttcccgtttaaccgg

SEQ ID NO: 146427 - DNA, 703 bp, Homo sapiens
  misc_feature: GYAE6OF02HGHWL.21.4.A04.1.454.CMB.1.raw
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcgtgggttttccttgttgttatttacaaggtgtccagtgtgaggtgcagctggtggagtcgtgggggagacgttggtccagccgtgggacgggtccctgacgtactctcctgtcgcacgcctctgactattccaccttcagtcgaaccacaacagtcggacgtcgggtccgccgacggcctacggaaggggacgggtcgtggggacggtggggtccggaccggttaagttaacggaaaggtaaacgtaccgtaaacgtaagttaaccgaaggtaacaaaggaacgtaaccgggcgtacgttcggtagggtaaggaaaacgggtacggtttacccaaccgttagtacctaacggaaaggagtaagttagaactttaaaccgaaaagtaccgttacaaccggttagttaacttccgtagaaaccttaaagacgaaacacgtacccgtaaagaaacccgggaagacccgaacgggtaccgttagttacttaggttggtaaggtaaacggaactaaagggtagtaggagttagggttggtaacggtagtacggtgtacg

SEQ ID NO: 146428 - DNA, 518 bp, Homo sapiens
  misc_feature: GYAE6OF02FMYWY.21.4.A04.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagctccagccagaatatccagagctactacatagcctggtaccagcagaagcctggccaggctcccaggttcctnatctatgctgggtcccacgagggccacgtggcactcccagacaggttcagtggcagtgggtctgggacagacttcactctcatcattacgctagactggacgccgtgaagtntttcgctagttgtattcgtntcagtcagttagtggtaagttcacttctggtcgttcgaccgagggaccaagggtaacaagtacgaaacgtacgtgtacggctaggacacgtatctcg

SEQ ID NO: 146429 - DNA, 620 bp, Homo sapiens
  misc_feature: GYAE6OF02IMWYE.21.4.A04.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
tcagtcgtcgctcgcacgaccggtgctcgatttagagtagtgatcaggggagagctgctcagttaggaaccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagcctccagccagaatatccagagctactacatagcctggtaccagcagaagcctggccaggcctccgaggttccctnactctagtgcgtcggtccccagacgggcccagtcggccactcccagacgtgttcagtgacgtaggtggtcgtgggacngtactcactctcatcattacgnagtacgtggacgtcctaggtaagtactttacgacgtagttgttaacttacgtgtacagtacgtaagttacgtagggtaacctttcgtaacccgtttcgtacggtttacggttacccggaccggtaacgggtaaccgtaacgggtaaagtaaacggtaacggtaaaaccgtacgttaagggttacggacgtaccggtacctaaccgttacgttaccgtttaacgg

SEQ ID NO: 146430 - DNA, 608 bp, Homo sapiens
  misc_feature: GYAE6OF02JEM5S.21.4.A04.1.454.CMB.1.raw
  modified_base (401)..(401): a, c, t, g, unknown or other
  misc_feature (401)..(401): n is a, c, g, or t
  modified_base (473)..(473): a, c, t, g, unknown or other
  misc_feature (473)..(473): n is a, c, g, or t
  modified_base (511)..(511): a, c, t, g, unknown or other
  misc_feature (511)..(511): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgagtgcagctgggtggagtcgtggggggagtacttggtccagcccgtgggacggggtcccctggacgtactctccgtgtgcaggccctcgtcgcctaattccaccttcagttcgacccacaacatggacgtcgggtcccgaccaggcctccgaggggagggctggagtcgggtcgccgtatacgaaaggaagctaacagttacagtaacagtaancggactcggtctgtaaggaaacggtaggttacacctatctacagtaatatagaattacaaagtaactcactntactctacgacaaatgaacgagtacctaagaaaaccgnggaaacgtaccgggcttaagtacttaagtggtaacggtaaggaacaaaaggtacggtagaacggttggttacgggtaggttaggccgtggtaaccgg

SEQ ID NO: 146431 - DNA, 647 bp, Homo sapiens
  misc_feature: GYAE6OF02IS312.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggagaaattgtgtgacgcagtctccaggcaccctgtcttgtctccgaggggaaagngccaccctctcctgcagctccagccaagaatactaccagacgctaactacatacgccgtcggtacccagacgaagaacgcctggccaggcctcccgtaggttccctcgactcctatcgtccgtcggtacccacgacgggtaccacgtggcctacgtacccgagaccgtaggttcaggttggcaggtgggtcgtagggactacgtacttcacgttctactagtactagtacgactacggacgtaggaacgtcctaaggaacgttacgtttccggtagtaggttacgttagtttacgtcgtacgagactaaggttacgttaaggttacgttctaccgttacgttggttcccggttacgacccgtaacgggtaccgtaaggtaacgtaaacgttaacggtaaaccggtacgttggtacggaccttacggacctaacgtacgttccgttacg

SEQ ID NO: 146432 - DNA, 708 bp, Homo sapiens
  misc_feature: GYAE6OF02I751W.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatatccagagctaactacatacgcctggtaccagcagaacgcctggccaggctcccaggttccctcactctatgcgtcgggtcccaacgacgggcccaacgtcggactacgtcccgaagaccgagggtttaccaacggttggcgtaagggttcggggttcgtggggaacagtacccttcgacttcgtactatacgtaattaacgcaaggtaccgtgggacgtaccgttaggaacgtacgtttacgacgtagttgttaacttacgttgtaccgtagcgtaaggttaagttacgggtaaactttcccgtaaccgtttccgttacgggtttaccggtttaccggggtaacccgtaaacgggggtaacccgttaaaacggggttaaacggtaaaacgtttaaacgggaaaaaccgttaacggttaacgggtacgggtaccggttaaccggtaccgtaacccggttacgttacccgttaccgg

SEQ ID NO: 146433 - DNA, 532 bp, Homo sapiens
  misc_feature: GYAE6OF02G5383.21.4.A04.1.454.CMB.1.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (390)..(390): a, c, t, g, unknown or other
  misc_feature (390)..(390): n is a, c, g, or t
  modified_base (445)..(445): a, c, t, g, unknown or other
  misc_feature (445)..(445): n is a, c, g, or t
  modified_base (471)..(471): a, c, t, g, unknown or other
  misc_feature (471)..(471): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaggtgtccagtgtgaggtgcagctggtggagtctgggggagacttgggtccagcctggagggtccctgagactctcctgtgcagcctntgcattcaccttcagtgaccacaacatgggactggggtccnccgaggcctccgaggggaaggggctgggagtgggtcggccgtattacgaaggaagctaaacagttacagtacagaatacgcgcgtctgngaaaggagttcacatcgtcaaggagatgaattacgaaagtaactcactgtatctnactaaatgaacacgctagaaaaccgngaacacggcgtatatatgnggtaanacgaaagngtggagtaggtggtaggtagctggtacg

SEQ ID NO: 146434 - DNA, 785 bp, Homo sapiens
  misc_feature: GYAE6OF02JLLS8.21.4.A04.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccaggcaccctgtctttgtctccaggggaaagagccacctctcctncagctccagccagaatatccagacncctactacatacgcctggtaaccagcagaacgcctgggccaggtacctcccgaggttaccctcgacttctactcggcgttacgggtaccccacgtacggggcctaaccgtcgggccaccgtacccacggtacgtaacggtttcgaacggtcgggacctacgggtttacggggtcgttcggggggaacctaacgggtaacccgttttccgacccgtttcgttacccgaacgttacctaaaggttttacgaccggtaagtacccgggttagggtaccggtaccgttaagggtaaacggtttacgtttaccggtacgttaacgggtttggtttaaacttaccgtttacgggtctaacggtaccgttaaggttacggttacggttaaacgttacccgttaacgtttccggttacggtttcccgggttaccgggaccccgtaggggtaacccggtaagggtaaacggttaaacggttaaccggaaaaccgtaacggttacgggttaaccggcgttaacggacccggtaacccttaggttaccgtttacgg

SEQ ID NO: 146435 - DNA, 594 bp, Homo sapiens
  misc_feature: GYAE6OF02HD9H3.21.4.A04.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacttgggtccagcccgtgggacgggtccctgagactctcctgtgcagcctctgcattccaccttcagtcgaccacaacatggacgtgggtcccgccgaggcctccgaggggaagggctgggagtgggcggcgtatacgaaaggaanctaaacgagttaacagtaacagaactacggcgcgtcgtagtaggaaagggtacggttcaacctatacctacgaaagagatagaattacgaaaagtacctactaactgtactctagacaaaagtcgaaacagaccgtaacgaaaaccggaggaccacgggtccgttagtactttagttggtaggtaagaagtaaagtggtaggagttgggtagggtaggtacgtgtggtacg

SEQ ID NO: 146436 - DNA, 576 bp, Homo sapiens
  misc_feature: GYAE6OF02GZMOH.21.4.A04.1.454.CMB.1.raw
  modified_base (289)..(289): a, c, t, g, unknown or other
  misc_feature (289)..(289): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagaaaccaccggagagattgtgttgacgcagtctccaggcaccctgtctttgtctccagggacagagccaccctctcctgcggggccagtcaaattgttacccgcgactacttagcctggtaccagcagaaacctggccaggctccagactcctcatccanaatatattctacaggccgcggcactcccaagacagttcagtggcaggtggtctggacaggacttcacgtctcaccatcagcagactggacgccgtagaacgtattttacgactaagttagttacttacgtacgtcaggtacaattatcgacctcctacccccgattacctacccgttaccggaccgaacgggacctacgacgtacgacagactacgaaacgacgtcggtagtaccgtgtaccgaccgtacttacgtacgttccgttacctacttacccgttaccccg

SEQ ID NO: 146437 - DNA, 626 bp, Homo sapiens
  misc_feature: GYAE6OF02JXLAW.21.4.A04.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgtggcatcgacgttgcctggtaccaanaaaacctggccaggctccagtctcctcatctatggggcatcctacaggatgtaccggcatcccagacacggttcagtgccaggtgggtctggggacaggacttcgactctcaaccatcaacacactacgggcacctgaacgtattttcgacagttagtattactgtacagtatgtagtagggttagtccgtaacgtaccgtaccgtttagggacccggagggtaacccgtaaaggggtcggtaacgaacgttaccgaacgggtaaccgtaaccgttagggtaaccggggtcgtaccggtaacccgaacccgttaagttcccggtttacggttaaccttttacccgtaactttccccgtttacccccggtaacccg

SEQ ID NO: 146438 - DNA, 719 bp, Homo sapiens
  misc_feature: GYAE6OF02HKX08.21.4.A04.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagtcgtcgctcgcacgaccggtgctcgatttagagtagtgatcagggggagagctgctcagttaggacccagagggaaccatcggaaaccccagcgcagcttctcttcctcctgctactctggctcccaggctcagaaaccaccggagaaattgtgttgacgcagtctccaggcaccctgtctttgtctaccgaggggaaacncgccaccctctcctgcagctccacgccagaatatccagagctacacatagcctaggaccagcagacgcctggaccaggctcccgagttccacatctancgctcggtaccacgacggccagtcggacacgtcccgaagaccgtacggttcaggtcggactagggttcgggtacgtgggaaccagtaccttacgacctcgtacacgttctaacgtttacggacgtaacggtaccgttagggaccgttaccgttaaggtaacgtttcgtttaaccggaacgtttagggttacggtttaaacttacggttacgtaacgttacgggtaccttaagggttttacgtaacgggttaacctttaccgaaccgtttcgtacgggttaccgttaccgggaacccgttaacggggtaaccggttaaggttaaaccggtaaacgttaaccggtaaaaccggttacgtttacgggtaccggttaaccgtacgtaaccccgtaaccgttacggtttacggtttacccg

SEQ ID NO: 146439 - DNA, 663 bp, Homo sapiens
  misc_feature: GYAE6OF02IJVVZ.21.4.A04.1.454.CMB.1.raw
  modified_base (218)..(218): a, c, t, g, unknown or other
  misc_feature (218)..(218): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagcctggagggtccctgacgactctcctgtgcagcctctgcattccaccttcagtcgaaccacaacatcggactcggggtccgaccgagggtcctccggaaggggaacggggtctaggggtaggtcggggggtccggtaccgtaagttaaccgaaaaggtaaaacggtcctaaaacgaggtttaacaaggttaaccaaggtaaacgtacggcgtacgtactaggtaggaaaaggtacgttaccacatctacaagngatanatacgaaagaactacaactgtactctagacaaatacgaacacgaccgtaacgaaaacccggtacggaacgaaccgggtacgttagttagttagtttacggtaagggtaaacgtaaacgtaaaaaggtacggtaagggtaagttacgggtgggtaggtacggttacgtaggtaacg

SEQ ID NO: 146440 - DNA, 844 bp, Homo sapiens
  misc_feature: GYAE6OF02I9W91.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagcccgtgggacgggtccctgacgaccttctccgtgtgcacgcctctgctattccaccttcagtcgaccacaacatggacgtcgggtccgaccacgggcctaccggaaggggaacggggtcgtaggggacgggttcggggtaccggtacccggttaagttaaaccggaaaagggaaacgtaccgtaaaacgtaggttaaaccgaagttaaacgaaaggtaaacgtaccggggaccgtaccggttacgttagggtaacgggtaaaacggggtacggtttaccccaaaccgtaacgttaccgtaagaaacggtaagtaagttaggtaaacctttaaccgaaaaacggtaaaccctttccgaaacgttagttaaccttaccgtaggaaacctaaaaagtaccgaaaaccgtacggtaaccccgttaaaacgggaaaaaccccgggtaagggaaaccccggtaaaccggggttacccgtttaagtttaaacgttttaacggtttcgggttaaacgggggttaaacgtaaaaaccgggtaaaaaagggttaccgggttaagggttaacggttacgggggttacgggggtttaaggtaacggttaccggttaggtaaacccgg

SEQ ID NO: 146441 - DNA, 663 bp, Homo sapiens
  misc_feature: GYAE6OF02HCN1K.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctctcctgcagctcagccagaactatccagagctaacacatagcctaggtaccagcagaacgcctcggccaggcctacccgtaggttccctacacgttcctaatcggtaccgttcgggtaccccacgacgggccctaacgtcggcctacctacccgagaccgtacggttccgaggttcggacctagggtcgggttcgtagggactagtaccttcacttcgtacactactacgttacgacgtacgtacgtcggacgtaccgtaggtaagtacgtttcgacgtaggttacgtacttacggtcgtactaacgcgtaaggttaagttaggtaacgttactacccgttcgttcggttaccggtacggtacccggtaacgggtaaccgtaagggtaaacggaaacgttaaggtaaaccgtaacgttcgggtacgtacgtacgactaccgtacgttccgttacg

SEQ ID NO: 146442 - DNA, 640 bp, Homo sapiens
  misc_feature: GYAE6OF02I23SI.21.4.A04.1.454.CMB.1.raw
  modified_base (403)..(403): a, c, t, g, unknown or other
  misc_feature (403)..(403): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccgaggggaagagccaccctctcctgcagctccagccagaatatccagacgctaactacatacgcctggtaccagcagaacgcctggccaggcctccgaggttccacattctagtcgccgttcgggccccaacgacgggccacgttggccacgtcccagaccgtaggttacaggtggcaggttcgggtctagggaccagtacttcacttcctnactcattagctagactggacgccgtagaacgtcgtttacgacgtaggttagttacttacgttcgtacgtacgacgtaggttagttacggttaacgtttacccgtaccgttcggtttaccggtttaccgggttaccgggtaacccgtacggggaaccgtaaagggtaacggtaaaaccgttagggtaaaaccgtacgttacggtacggtctacggacctaaccgttagttccttacgg

SEQ ID NO: 146443 - DNA, 821 bp, Homo sapiens
  misc_feature: GYAE6OF02JXDQL.21.4.A04.1.454.CMB.1.raw
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (446)..(446): a, c, t, g, unknown or other
  misc_feature (446)..(446): n is a, c, g, or t
tcagtcgtcgctcgcacgaccggtgctcgatttagagtagtgatcaggggagctctgagagcggagccccagccccagaatcccaggtgttttcatttggtgatcagcactgaacacagaggactcaccatggagttgggctgagctgggttttcctgttgttatttacaaggtgtccagtgtgaggtgcagctggtggacgtcgtgggggatacttgggtccaggtcccgtgggacgggtccctgacgtctcctcgtgngcgagtcctncgactcttaccgtacccttcgtaggtccaacccgaactaaactcgggtcggtaccggttcgggccccgaacccgtgggtaccctccggggaaagggggtaccgggcgtgggtaacgggtcgggtcccggtacttaaacgtacggaaaaaggtaacgtacgtaaacgtccgttaaanacgtaaacggaataaacggcggtcgacgtttcgaaggttaacgggaaaacgggttaccggtaccgtaaccgtagttaccgtaacggaaaggtagtacgtagttaaccggtaataaaacgttccgtaattaaccgtaacgtacgttacgtagaaaccttaaggtaacccgtaaaagcccgggttaaaccgggtaaaaccgaaaaccgggtaccggaaacggggttaccccgtaaaccgggtttataaagggtttaccgttttaaggggaacgggggttaaaaaccgtaaaacgtaaaacgggggtttaaagtcggttaaaccgggttgggtaaacgggggttacgggtaaacgttcccggggtaagtttaaacccg

SEQ ID NO: 146444 - DNA, 759 bp, Homo sapiens
  misc_feature: GYAE6OF02GYXRU.21.4.A04.1.454.CMB.1.raw
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaanagccacctctcctgcagctccagccagaatntccaagngctactacatagcctggtaccagcagaacgcctggccaggctcccaggttccncatctatcgctcgggtccacgacgggccacgtggaccactcccgaggaccgtaggttccgaaggtcgggacgtaagggttcggggtaccgtaggggacctaacggtacccttttacgaaccgttccgttaccgacgtttaccgtaacgttttacggaccgtaaggtaaccggttacgggaagtaaccccgttaggtaaaccggttaacgttttaccgggaccttaaagggtttacggtttaaactttacggtttacgtaccgtaacgttaaccgttaagttttacggtaacgggttaaccgtttaccgtaaccgtttcgttacggtttaccggttacccgggtacggtaaaccgggtaaccggttaaaacgggtaaacggttaaaacggttaaaccgggtaaaaccgttaacggtttacggggtacggttacccgtaggtaacccgtaacccgttacgttaccgttaacgg

SEQ ID NO: 146445 - DNA, 590 bp, Homo sapiens
  misc_feature: GYAE6OF02H1YS9.21.4.A04.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (490)..(490): a, c, t, g, unknown or other
  misc_feature (490)..(490): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggtttcctgttgttattttacaaggtgtccagtgtgaggtgcagctggtggagtctggggganacttggtccagcctggagggtccctgagactctcctgtgcagcctntgcattcaccttcagtgaccacaacatggactggggtccncgaggcctaccgaggggaagggctgggagtgggtcggccgtatacgaaggaagctaacagttacagtacagaatcggcgcgtcagtagaaacggtagttccactatctacgaagagagtagattacaaaacgtactacaacgttagtactactagacctaaattacgaaactacgcctaagaaaacccgnggaaaccgacggaccgttagtattagttaggtaggtaacgaacgtaaaaggtacggtaggtaacgttgggttaggttagggtaacggtcgtaggtaaccg

SEQ ID NO: 146446 - DNA, 597 bp, Homo sapiens
  misc_feature: GYAE6OF02I4JYI.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatacgcctggtaccagcagaagcctggccaggctcccaggttcctcatctagtggggcatcctacaggatgaccggcactccagacaggttcagtcgcagtgggtctggacagactcactctcacatcaacacactcggcgtaccgtgaagtatttgcctagttgttaacttacttgtactaggtattaggttagttgggttaaggtaccgtaaccggttaaccgttaccggttttacggaccggtaacgggggtaacccgtaaggggttacggaagtaacgtaccgtaacgggaaccgttaacgttcgggtacggtcgtaccggacgtaacccgtacgttccgtttaccgg

SEQ ID NO: 146447 - DNA, 711 bp, Homo sapiens
  misc_feature: GYAE6OF02G25QP.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgagggaangccacctctcctgcagctccagccagaatactccagacgctaactacatacgcctggtaccagcaagaacgcctggccaggcctacccgaggttccctacgattcctaagtcgccgttcgggtaccccacgacgggccacgtggccacgtacccgagaccgtaggtttcacggtggacgtagggttcgggtcgtacggggactaacggtaccttccgtacttcctaacgtactaccgtaagtttacgacgtaacgtacggtagggacgtaccgtaggtaacgttactttacgggacgttaagggtttatttaacgtttaccgttacgtacgtacggtacgttaaggttacgttaacggggttaaacctttccgtaaccgttttccgtaggttacccggttaccgggaacggttaaacggggtaaccgtaaacgggttaacgtaaaggtaaccgggtaaaacaccggtttagggtaacggtcgtacggtaaccgaacgttacgttcgttaacgg

SEQ ID NO: 146448 - DNA, 662 bp, Homo sapiens
  misc_feature: GYAE6OF02F8MLM.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccaccctctcctgcagctccagccagaatatccagagctactacatagcctggtaccagcagaacgcctggccaggcctcccgaggttccctacatctatcgcgtcgggtccccagacgggccacgtggccacgtcccagaccgtaggttcaggtcggactagggttgggtactcggggactacggtacctttccacgttccgtactaatcgtaacgtttacgacgtaggtacgtaggacgtaccgtaggtaacgtagtttccggatacggttagttactttacgtggtactaggtaccgtaaggttacgtagggttaactttccgtaaccgtttcgttacggttccggttacccgggaccgtaacggggtaaccgtaaaggggttaaacgaaacgttaacgggaaaaccgttacggtaggttacggtacgttacggaaccctaaccgtagttccgttacgg

SEQ ID NO: 146449 - DNA, 693 bp, Homo sapiens
  misc_feature: GYAE6OF02JOJC0.21.4.A04.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcagggaggagctgctcagttaggacccagagggaaccatggaaaccccacgacgcagcttctcttcctcctgctactctggctcccaggctcagaaccaccggacgaaattgtgttgacgcagtctccaggcaccctgtcttgtctccgaggggaanagccacctctcctgacngcctccagcccaagaattcaccagtagccttacacagttacgcctcggtaccagctagaacgcctggcccaggtcctccccgagtttcccnactgtactgctcgggtacccaggccggacctacgtggacctactacccctaggaccctagggttcctaggttacgcggtagggttacggggttccgtacgggggactaacgtaacccgtttcgaacctttccgtaccttaacgtccttaacggtacgtaccgtaggacccttaggggacctaccgttacggaacttagtttccgacgttacggttagtaacgtttaagttcgtacgttagaccgttaagttacggttaggtaacgttccttaaccgtcgtttacggtccggttacgaccggtacggaaccgtaaggtaacggttaagtaaggtaaacccgtagttcggtggtaccgtacggtaccctactacgttcccgttacg

SEQ ID NO: 146450 - DNA, 671 bp, Homo sapiens
  misc_feature: GYAE6OF02JE7VJ.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgggagaaattgtgttgacgcagtctccaggcacctgtctttgtctccgaggggaaanagccaccctctcctgcagctccagccaagaatatccagacgctactacatagcctggtaccagcaagaacgcctggcccaggctcccgaggttcctcattctatgcctcgggtacccacgacgggccacgttcggctactccccagacctaggttcaggttcggactagggtcgggtcgtgggactacgtacctttcacttctctatctaacgttacgctaacggacgtacgggacgtccgtaggtaacgtacgtttccgacgtagttagttaacttacgttcgtactaacggtcgttaagttacgttaacgggtaacgtttccaacccgtttcgttccggtttaccggttaccgggtaacccggtaacgggtaaccgtaaacgggttaacggaaaagttaaccgggtaaaccgtaaccggttacggttacggtaccttaccggaaccgtaaccgtacgttaccgttacg

SEQ ID NO: 146451 - DNA, 830 bp, Homo sapiens
  misc_feature: GYAE6OF02H334V.21.4.A04.1.454.CMB.1.raw
  modified_base (237)..(237): a, c, t, g, unknown or other
  misc_feature (237)..(237): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgtctttgtctccgaggggaaagcgaccaccctctcctgcacgctccagccagaatacnccagagcctactacatacgcctaggtaaccagacaaggaacgcctgggaccacggcctacccgtaggtttcccactaattctaacgtcgccgttcgggtaccccaacggtaccggggacccacgtcgggacctaacctacccggaagtaccgtacgggtttaccgacgggtgggaccgtaaggggttccgggttacggtacgggggaccctaacgttacccgtttccacccgttacgttacctaacgtttaccgtaacgtttaacggaaccggtaaacggtaaccggttacgggtaaccgtaacccgttaagggaaacggttttaccgtttaccggtacgttaaggttttaacgtttaacgtttaacgtccggttaacgaacggttaccgtaaaggtttaccgttaaacggggttacctttacccgtaccggttttccgtacgggttacccgggtttaaccgggaacccggttaacggggtaaccgttaaaggggtaacggttaaaacggtaccggtaaaaccggttaaccggttcgggtacggttaccgtaacccggtaacccgtaaccgttaccgttacggtttaacccgg

SEQ ID NO: 146452 - DNA, 586 bp, Homo sapiens
  misc_feature: GYAE6OF02HVLLZ.21.4.A04.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagaaattgtgttgacgcagtctccaggcaccctgtctttgctccaggggaaangccacctctcctgcagctccagccagaatatccagagctatacatagcctggtaccagcagaagcctggccaggctcccaggttccncatctatcgctggtccccacgacgggccacgtggccatcccgagacaggttccaggtgcaggttgggtctagggacagacttcacgttctcatcagttagctagacgtggacgtcctaggtaacgtctttacgcgtaagttgttaattactgactagactaacgttagtacggtaacgttcctaaccgttcgttacggtccggttaccggacccgaaggggtaacccgtaagggtaaacgaaagttaaggaaaccgtaacgttaggtacggtactacggacctaaccgtacgttcgttacg

SEQ ID NO: 146453 - DNA, 673 bp, Homo sapiens
  misc_feature: GYAE6OF02GOWHZ.21.4.A04.1.454.CMB.1.raw
  modified_base (212)..(212): a, c, t, g, unknown or other
  misc_feature (212)..(212): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttcctgttgttatttacaaggtgtccagtgtgaggtgcagctggtggagtctggggganacttggtccagcctggagggtccctgagactctcctgtgcagcctctgcattcaccttcagtgaacccanaacatggactggggtccnccgaggcctaccgaggggaaggggctagggagtggggtcggaccgttaatacgaaaggtaaacgctaaacagttaacaagttaacaagtaatacggcgcgtacngtagaaacgggaggtttccaaccgtatcctacgaaaggtacgagttaggtaacttaacgaaaaacggtaaccttacgtaacttacggttaactacctaacggtaacctaaaagttacgaaaaccgtaacgtacccgttaacgggaaaaaaccccgtgggaaacccgtaaccgggtccgttaagttagtttaacgtttgggtaacggtaaagaaaccgtaaaaaggtcgtaggtaacgtaggttagggtaggtacgtcgtaggtaaccgg

SEQ ID NO: 146454 - DNA, 795 bp, Homo sapiens
  misc_feature: GYAE6OF02JAK9N.21.4.A04.1.454.CMB.1.raw
tcagtcgtcgctcgcacgaccggtgctcgatttagagtagtgatcaggggagctctgagagcggagccccagccccagaattcccatgtgttttcatttggtgatcagcactgaacacagaggactcaccatggagtttgggctgagcttgggttttccttgttgttatttactaaggtgtccagtgtgaggtgcagctggtggagtcgtgggggagacgttcggtccagccgtgggacgggtccctgagactctcctgtgtcacgcctcgtgctacttcaccttcgacgtcgaaccaccaacagtcggaccgtcgggtcccgacccgacggcgtacccggaggggaacggggtcgtcggggaaggttcgggggtaccggacccggtttaacgttaaacggaaacggggtaaaacgtaccgtaaaaccgtaggtttaaacacggttaaacgtaacggaaacgttacgggaccggtcggttacgttaggtaacggtaaaagggttaaccggttaccaaaccgtaagttctaaaccggaaggtaaagtacgtaacggtaaacttaacggaaaactaaaccgtcttaaccgtaggtttaactaaccggtagtaaccgtaaaaattacccggaaaagtacccggttaacgaaacggaaaaaccccgggacgtaaacccggtaccggggtaaccgtttacgtttaaaggtttaggttaacgggtaaacggtttaacgaaaaaccgttaaaagggtcgtaaggttaggttacggttaggggtacgtagggaccttaagggg

SEQ ID NO: 146455 - DNA, 785 bp, Homo sapiens
  misc_feature: GYAE6OF02IBQBL.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgagtgcagctggtggagtcgtgggggagacttggtccagcctgggagggtccctgagactcgtcctgtgcacgcctctgcattcaccttcgagtcgaccacaactatgggaccgtcggggtcccgccgacgggcctccggaagggggaacggggccgtagggacggttggggtccggaccggttagttaacgaaaggaaacgacgtaaacaggtttaaccaagtaacgaagaaagtaccgggccgtacggtacgttagggtaacgggaaaacgggtaacggttacccgaaaccgtaactaccgttaacgaaacgggtaagtaaggttacggtaaactttaaccgaaaacggttaaaccttaccgtaacgttaacggttaacttaccgtaacggtaactaaaaggttacgtaaaaccgaacggtaacccgtaacgggaaaaaacccgggttacggaaacccggtaaccgggtacccggttaaggtttacgtttaacggtttaagggttaacggggttaacggtaaaaccggtaaaaaggtacggttaacgggtaagtttacgggtaggggttacgggttaaggtaccggttagggtaacg

SEQ ID NO: 146456 - DNA, 802 bp, Homo sapiens
  misc_feature: GYAE6OF02F5LZ5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacgttgggtccaggccgtgggacggggtccctggacgaccttccgtcctgtcgcacgcctctcgctattcctaccttcaagtcgaaccacaactatggaccgtcgggtcccgccgacggtcctaccggaagggggacgggggtctaggggacgggttggggtccgggtaccgtaacgttaaccggaaagggtaaaggtacctaaacgtaacggtttaaccaaggtaactaagaaacgtaccgggcgtaccgtacgtaggtaacggtaaaaggggtacgggttaccaaccctaagtccgtaaacgaaggaacgtagttacggtaaacttaccgaaaaaggttaacctaccgtaacgttacgttaacttccgtaagaaaccgtaaaattaaccggaaaccgtaaaccgggtaaccccggggaaaaaacccggtagggaaaccccgggtaaacgggtaccgggtttaacgttaacgttttaggttagggttaacggtaaacgggaaaacgtaaaaggggttacggtagggtaagttacggggggttaacggttcggggttaacgtacggttaggtaccgtaacccgg

SEQ ID NO: 146457 - DNA, 773 bp, Homo sapiens
  misc_feature: GYAE6OF02JQ0GT.21.4.A04.1.454.CMB.1.raw
  modified_base (559)..(559): a, c, t, g, unknown or other
  misc_feature (559)..(559): n is a, c, g, or t
  modified_base (662)..(662): a, c, t, g, unknown or other
  misc_feature (662)..(662): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacgttggtccaggccgtgggacgggtccctgagtacctctccgtgtcgcagcctctcgctattccaccttcgagtcaaccaacaactagtcggtaccgtcggggtcccaccgaacgggtcccgtaccggaagggggtaacgggggtccgttaggggacgggttcgggggtaccgggtacccggttaaacgtttaaccggaaaaggggtaaacgtaaccgtttaaacgtaacggttaaccgtaaggttaaccgaaaggtaaacgttaccggccggtaccggttacgtagggttaacggaaaagggtaacggttaccaaacgtacgtacgtaacgaaaggtanacgttaaggtacttaaacgaaaacgtaacccttgtaaccgttagttaaccgtactaaaggaactaaaaggtacgaaacgtaccgaccgtaaacggaaaaccgnggaacccgtaacggtcgttaaggttatttaagttcggtaagggtaaacaaacggtaaaggtaggttagggtaacgttgggttacgggtaaggttacggtattcgggttaac

SEQ ID NO: 146458 - DNA, 569 bp, Homo sapiens
  misc_feature: GYAE6OF02FIKFZ.21.4.A04.1.454.CMB.1.raw
  modified_base (215)..(215): a, c, t, g, unknown or other
  misc_feature (215)..(215): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (455)..(455): a, c, t, g, unknown or other
  misc_feature (455)..(455): n is a, c, g, or t
  modified_base (542)..(542): a, c, t, g, unknown or other
  misc_feature (542)..(542): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctggggganacttggtccagcctgggagggtccctgagactctccgtgtgcagcctctgcattcaccttcagtcgaccacaacatggactggtccgcaggctccgagggaaggggctgggagtgggtcggccgtattacgaaggtaaagctaacagttacagtacagaatacggcgtcgtctgtagaaaggacggttcaccgntctacaagtanactgatacgaagactcaatgtatctacgactaaangaacagtaccctaagaaaaccgtaggaccgacggaccgttagttattacgttggtaacggtaagaaccgtaaaaggtggtagggtancgggttaggtacggagttcgtggtacg

SEQ ID NO: 146459 - DNA, 702 bp, Homo sapiens
  misc_feature: GYAE6OF02JK3PQ.21.4.A04.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (533)..(533): a, c, t, g, unknown or other
  misc_feature (533)..(533): n is a, c, g, or t
tcagtcgtcgctcgcacgaccggtgctcgatttagagtagtgatcagggagaggctgctcagttaggacccagagggaaccgatggaaaccccagacgcagcttctcttcctctgctactctggctccagctcagaaaccaccggagaaattgtgttgacgcagtctccaggcaccctgtctttgtctccaggggaaagngccacccgtctccngcagcctccagcccagaatactccagacgcactacatagcctggtaccagcagaagccgtcgccaggtcctacccgaggtttccctacatcgttaatcgtcgtcgggtaccccncgagggcccaccgtggacctacgacccctagaccgtaggttaccaggttcgggactgggtgggtcgtggggtaaccagttaaccctttgaacccttcttcccgaatttcaacgtttacgaccaagggtacctagggtacgtaccggttagtaaacgtacgttttaccgcgttaacggttaggttacctttaacgttcgtaacggngaacttacgggttaaagtcggggttaaaccttactccgtttccggtagttttcccggttacggaacccggtaaggggaaccggttaacgggttaaaggtaaactaaacggggaaaccgtttaagtaacggttcggtaccggtggaaccccgccttaagttccgtaaccg

SEQ ID NO: 146460 - DNA, 577 bp, Homo sapiens
  misc_feature: GYAE6OF02F0KP3.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaactatccagagctactacatagcctggtaccagcagaagcctggccaggcctcccgaggttccctcatctatgctgggtccccagacgggccagtggcactcccagtacaggttcagtggcaggtgggtctgggacagtacttcacgtctacatcaattagcagacgtggatccgtagaagtatttcgacgtagtagttattactgtacagtctagtagtaggtaacgttcaccttcgtacggttcgtttccggaccgtacgggtaaccgtaaagggttaacggaaacgttaacgggaaaccgtaacgttggtacgggtacttacggaccctaaccgtcgttcttacg

SEQ ID NO: 146461 - DNA, 542 bp, Homo sapiens
  misc_feature: GYAE6OF02IU01I.21.4.A04.1.454.CMB.1.raw
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (537)..(537): a, c, t, g, unknown or other
  misc_feature (537)..(537): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtcgtgggggagacttggtccagcctggacgggtccctgagactctcctgtgcagcctctgctattccaccttcagtgacccacaacatcggacgtgggtccgccaggcctccgaggggagggctggaggtcgggtcggccgtaatacgaaaggaaagctaaactagtacagtacagaaatcgcgcgtcgtagtagaaaggtaagtccaacatctacaagagatgtaatacgaaagtacctatactgtatctagacaaagtnaacngacctaagaaacgngacaccgctgtattgtaggngtaanaacgaaagngtagagtggtggtgacgtcngtacg

SEQ ID NO: 146462 - DNA, 724 bp, Homo sapiens
  misc_feature: GYAE6OF02ITDVY.21.4.A04.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (582)..(582): a, c, t, g, unknown or other
  misc_feature (582)..(582): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcaagaaaccaccggagaaattgtgttgacgcagtctcaggcaccctgtctttgtctccgagggaaangcccacctctcctgcagctccagccagaatactccagtaacncttaactaacatacggcctggtaacccaggcaaggaacgcctagggacccagggtcctaccccgagggtttccccanacttcctaagtgtcccgttacgggtccccaacggaccggggacctaacgtggacctacgtacccgaagtacctaacgggtttccaggttcggacctagggtttcgggtcctaaggggacctaaggtccctttaccgaaccgtttcgtactaacgttacgtaaacgtttaacgacccgtaaggttaaccgttacgggacgtacccgttaggtaaaaccggttagtttaccggacttacggtttacgttaacgttattccggtaanacggtacgtaaggttacgtagggtaaacgtttcaaccgtttgttcgttaccggtacggtacaacggggttacaaaacgggtggaaactaacgggaaacgttacgtgggtaacgtactacgaccgaaccttgttaccgttacg

SEQ ID NO: 146463 - DNA, 892 bp, Homo sapiens
  misc_feature: GYAE6OF02IBKX5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcacatggagtttgggctgagtcgttggttttccttgttgttatttacgaggtgtccagtgtgaggtgcagtcgtggtggaggtcggtgggggacgtacgttcgggtaccacggtccgtaggggtacgggttccccttaggaccgttaccttccgtccgttggtcggacctacggtccccttcgtcggacttacctttccctaccgttcgtaacggtaccaaccctaacgaaacgtagtacgggaccgttaccggggtccccgaccggtacgggtcctacccggggaaggggggtaaccggggtcgggtacggggtacggggttaccgggggtcccgggtaaccggttaacggttaaaacggaaaacgggtaaacgtaaccgttaaaacgtagggtttaaaccgaacggttaaacgtaaacgggtaaacgtaccggggtccggtacccgggtttaggtacgggtaaaacggggtaaaacggttacgggttaacccctacggtaacctttaccgaaaggtaaaggtaacgtttaataacgttaacggtaaaccctaaaacgtaacccgtttccctaaagtttacgtacgtacgtaagtaaacgtaaacgtaaccggacctaaacggacccggttaaaaacggaaccgggacggaaaccggtcccgggttaattgtttaacggttacggttcggtaaaagggtaaccgaaaaggttacggttaagtcgggttgttacggggtaggttaacgcggttacggagttaaccg

SEQ ID NO: 146464 - DNA, 542 bp, Homo sapiens
  misc_feature: GYAE6OF02IEPAM.21.4.A04.1.454.CMB.1.raw
  modified_base (194)..(194): a, c, t, g, unknown or other
  misc_feature (194)..(194): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtncagctggtggagtctggggggagacgttggtccagcctggagggtccctgagactctcctgtgcagcctctgcattccaccttcagtgaccacaacatggactcggggtccnccgaggctccgagggagggcngggagtgggtcgcgtatacaaggaanctaangtacagtacagatacgcgcgtctgtagaaaggtagtacacatactacaagaganagtatacaaagtaactanactagtatctagacaaatagaacacgacctaagaaaccgaacggaacgacggacgtagtattagttgtaggtanaacgaaagagtaggtagtagtggtaggtagtgtgtacg

SEQ ID NO: 146465 - DNA, 720 bp, Homo sapiens
  misc_feature: GYAE6OF02IBMPU.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaccatggaaaccccagcgcagcttctcttcctcctgctactctggctcccaggctcagaaaccaccggagaaattgtgttgacgcagtctccaggcaccctgtctttgtctcgaggggaangccaccctctcctgcagctccagccagaatatccaagacgcctaactacatacgccttggtaccagcagaacgcctggccaggctcccaggtttcctcattctatcgctcgggtcccacgagggccacgtggcacgtcccgagactaggttcaggtcggacaggttgggtacgtcgggactaggtacttcgaacttctacctagtaccgtaatttacgccgtaagaacttacggggaagtcccgttaagggtaaacgtacgttttaccggacgttaaggttacgtttaacgtttaaccgttgttaccgtaagtaccgttaaagttacggttacgggttaaacgtttcccaaacccggtttccgttacggtttacccgggtttaccgggtaaccgtaaacccggggttaaaccccgtaaaaggggtttaaacggaaaaagttttaccggaaaaacccggtttaacggttaggttaacgggtaccgttaccggtaacccaacccggttacttaccgtttaccgg

SEQ ID NO: 146466 - DNA, 763 bp, Homo sapiens
  misc_feature: GYAE6OF02GLBVO.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctcgaggggaanagccacctctcctgcagctccagccagaatatccagacgctactacatacgcctggtaccagccaagaacgtccgtcgggacccagggtcctaccccgtaagggtttccctacgacttacgtactcggtccgttccgggtaccccaacggtacgggaccctacggttcggacctaccgttaccccgaaggtaaccgtacggtttaccgaacgggttcggggaccgttaaggggtttccgggggttaccgttacgggggaaccgtaacgggttaacccttttaccgtaaacccgtttcctacgtaacgttccgtaaacgtttacggaccgtagtaccggtgggaaccgtccgtaaggtaacggttactttacggacgttaacgttacgttaactttccgtgtaccgtagtaccgtaggttagttacggggttaacttccgttaccgttcgttaccggttaccggttaccgggaaccggttacggtaaccggtaagggtaacgtaaacggttacggaaacggtacgttgggtacgtacgtcgaaccgtaccttagtcccgttacgg

SEQ ID NO: 146467 - DNA, 572 bp, Homo sapiens
  misc_feature: GYAE6OF02H941N.21.4.A04.1.454.CMB.1.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (424)..(424): a, c, t, g, unknown or other
  misc_feature (424)..(424): n is a, c, g, or t
  modified_base (439)..(439): a, c, t, g, unknown or other
  misc_feature (439)..(439): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagngccacctctcctgcagctccagccagaatatccagagctaactacatacgcctggtaccagcagaancctggccaggctcccaggttccncatctatgctcgggtcccacgacgggccacgtggccactcccagactaggttcgagtggcaggtgggtctgggacagacttcgactcgtcagtctattagcagactggacgcgtagaagtatttcgactagtntagttactgtcagtntagtagtagtaagttccaccgttctggttccgtttacgggaccgaagggtaacccgtaaagggtaacggtaaacgttacggaaaacgtaaccgtagggttcggacgtcggtaacctaccgtacgttcgttacg

SEQ ID NO: 146468 - DNA, 673 bp, Homo sapiens
  misc_feature: GYAE6OF02IOW90.21.4.A04.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagctccagccagaatatccagacgctactacatacgcctggaccagcagaacgcctaggccaggcctcccgaggttccncatcatcgctcggacccagcggccagtcggctacctcccgagacgtacgttcagggttcggacgtacggttcgggtacctaggggaacctacggtaccctttccgaaccgttccgtaacctaatttacccgtaagtttacgccgtaacggtaaccgttgggaaccggtccgtaaggtaacgttacgtttccggtacgttaaggtttcttaaacgtttactggtacctagtacgtaacgttaggtaacgtaccggtttaaccacccgtttcgtacggttacccgttaccggtaaccgaacgggtaaccgtaagggtaaacgtaacgtaaccggaaagtaccgttggacggtacgtacgacctacgtacttcgtaccg

SEQ ID NO: 146469 - DNA, 708 bp, Homo sapiens
  misc_feature: GYAE6OF02H6OG1.21.4.A04.1.454.CMB.1.raw
  modified_base (567)..(567): a, c, t, g, unknown or other
  misc_feature (567)..(567): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagcctggagggtccctggagactctcctgtgcagcctcgtgcacttcaccttcagtcgaaccacaaacatcggacgtgggtccgccaggcctccgaggggaacgggtcgtagggaggttcggggtcggccgtaagttaaccgaaaggaaacgacgtaaacgagttaacgaagtaacaaggaacgtacggcgtcgtacgtggtaacggaaaggtacggtttaccacccgtattaccgtaacgaaagtagtaatggtaaatttacgaaaaacgtacctactacttaggttactaccgtgaacaaagttagaaccgaacgtaccgtaaacggtaaaaacccggnggtaacccgaaccggggtccttaaggtttacttaacggttttagggtagggtttaaaccggaaaacgtaaaaacgggttaggtagggttaacgttaggggttaaggggtttagggttaaacgtccggtttaggtaacccgg

SEQ ID NO: 146470 - DNA, 627 bp, Homo sapiens
  misc_feature: GYAE6OF02FTC8L.21.4.A04.1.454.CMB.1.raw
  modified_base (241)..(241): a, c, t, g, unknown or other
  misc_feature (241)..(241): n is a, c, g, or t
  modified_base (377)..(377): a, c, t, g, unknown or other
  misc_feature (377)..(377): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgtagtatttacaagtgtcagtgtgaggtgcagctggtggagtctgggggagacttggtccagcctggagggtccctgagactcncctgtgcagtcctctgcattcacttcagtgaccacaacatggactgggtccaccgaggctccgagggtaacggggctggagtgggtacggccgtagtacgaagaaagtctaacagttacagtacagaatacgggcncgtctgtacgaaaggagttacgacctaacgtctacgaacgagtactaggtacttacgaaaacgtaaccgtacgaacgttaggtaacttctacggactaaaagttacgaaaccgagtaccgtaacggaaaaccggaacggaaacgaccgggtacccgtagttaagttaacgtttaggtacggtaaacggtaaccgaaaaaggtagtacgggtaagttcggtagggttagggtaaggtccggttagtaccgg

SEQ ID NO: 146471 - DNA, 665 bp, Homo sapiens
  misc_feature: GYAE6OF02IFBBM.21.4.A04.1.454.CMB.1.raw
  modified_base (217)..(217): a, c, t, g, unknown or other
  misc_feature (217)..(217): n is a, c, g, or t
  modified_base (312)..(312): a, c, t, g, unknown or other
  misc_feature (312)..(312): n is a, c, g, or t
  modified_base (450)..(450): a, c, t, g, unknown or other
  misc_feature (450)..(450): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctgggacgggtccctgagactctccgtgtgcagcctctgctattcaccttcagtcgaccacaacagtcggacctggggtcccnccgagggcctaccggagggggaacggggctggggaggttggggtccggtaccgttaagttacgaaggtaaacgctaaacagttacagtaacaagacgtacggcgcgtctggtagaaacgggtagttccactatcgtanaagtacgatagacttaacgaaagtactacaacttgttactcgtagactaaagtacggaaaccacggtaccgtaacgggaaaacccgggtaagggaaacccgtacgggtacccgtttaaggttactttaacgggtttgggtaacgggtaacgaaacggtaaaaggtagggttacggaagttcgggttagggtagggttacgtcgttaggtaacccg

SEQ ID NO: 146472 - DNA, 827 bp, Homo sapiens
  misc_feature: GYAE6OF02I8607.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggtttccttgttgttatttacaaggtgtccagtgtgaggtgcagctggtggagtcggtgggggatacgttgggtaccaggcccgtgggacgggtccctgacgtactcctccgtgtcgcctacgcctctcgctactttccgaacccttcgagtcgaaccccaactaaacctagttcgggaaccgtcggggttccccgacccgacgggtcccgtaccggaaagggggtaacggggtccgttggggaacgggttcgggggtacccggtaccgtaagttaaccggaaaagggaaacgtaccgttaaacgacgttaaacgacggtaaaacacggaaacgttaccggggaccgttacggtacgttaggtaacggtaaaaagggggtccgtttaaccaacccggtaagtttccgaaacggaaaagtacggtaattaccgggtaaacttaacgaaaaacggtacttaaccgtacgttaaggttaacttcccgaaagtacctaaaaacgtcggtaaacccaacgggttaaacccgtaaaccgggtaaaaaccggaccggtaaacgaccggggttacccttaagtttaaccgttaaggttacgggtaacgggtaaaacgtaaacgtaaaacgggtgggtaaggtacgtttagggttacggtaggtaacggtcgttagggtaacccg

SEQ ID NO: 146473 - DNA, 788 bp, Homo sapiens
  misc_feature: GYAE6OF02IZ4FN.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagatccaccctctcctgcagctccagccagaatactccagacgctactacatacgcctaggtaccagcaagaacgcctggcccaggccctaccggtcgttccactactactagtcgcggtccggtaccacggcggacctacggtcgactaccgtacccgaagacgttacggtacgtagggtcgacggtaggggttcgggtacggtacgggtaacgtaaccgttacccgttaccgtaccgttccgtaacgtacttaaccgttaagttaaccggacgtaaacggtacggtaacgggtaccgtaccggttaacggtaacgttaccgtttacggtacggtttaaggtttaacgtttaaccgtttacgtaccggtaagtaacggtaacgttaaggtttaagggtaaccgggtttaacgtttcccgtaacccgttttcggttcccggtttaacccgggttacccgggaaacgggtaacccgggtaaacggttaaaacggggtaaacggttaaaacgtaaaccgggtaaaaccggttacggttacgggttaaccgtccggttaccggaaccttaccgtaccgtttacggttacccg

SEQ ID NO: 146474 - DNA, 602 bp, Homo sapiens
  misc_feature: GYAE6OF02JVWU5.21.4.A04.1.454.CMB.1.raw
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (469)..(469): a, c, t, g, unknown or other
  misc_feature (469)..(469): n is a, c, g, or t
  modified_base (565)..(565): a, c, t, g, unknown or other
  misc_feature (565)..(565): n is a, c, g, or t
  modified_base (593)..(593): a, c, t, g, unknown or other
  misc_feature (593)..(593): n is a, c, g, or t
tcagtcgtcgctcgcacgaccggtgctcgatttagagtagtgatcagggagagctgctcagttaggacccagagggaaccatggaaaccccagcgcagcttctcttcctcctgctactctggctcccagctcagaaaccaccggagaaattgtgttgacgcagtctccaggcaccctgtctttgtctcaggggaaagagccaccctctcctgcagtctccagccaagaactactccagagctactacatacgcctggtaccagcagaacncctggccaggcctccgagttcctnatctatcgngtcggtccacgacggcacgngcactccgagacgaggttcaggtcgctaggtcggtcgtaggacagtaccttcgacccttgtacgacttacgagtacgactaggacgtgggactccgtaggaagttacttacggacgttagttgttaactttacgtagtccaacgtntaaggtagtttgggaacttcgtaacccttagtcggtacccgttacgggacccgaagggtacctaaaggtaggtaaaccgaagtaaccgttaacggngggttacgacggtaccgaactaccggtnttacggtac

SEQ ID NO: 146475 - DNA, 740 bp, Homo sapiens
  misc_feature: GYAE6OF02IBTC6.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagcctccagccagaatactccagagcctactacatacgcctaggtaccagcagaagcctggccaggcctcccgaggttccacatcttagtgaccgttcgggtcccacgacgggccctaacgtggacctagtccccgaagtaccgtaggtttccagttcggcgttacgtggggttcctaggggaactacggaacctttcgaaccgttctacctattacgtacgtttacgaccgtaagtaccgttacgggtaacgtcccgttaggtaaacggttacgttttccggacgttaaggtttacgtttaacgtttaaccgttcggtaccgtaggtaccgttaaggtttaacgtttaacggggttaaaccgttttcctaaccggtttaccgttcgggtttaccggtttaccgggtaacccggtaacgggtaacccgtaaaaggggttaacggtaaaacgttacggtaaaaccgttaacggttacggttaacggtcggtaccggtacgaacccgtttacgtccgttttaccgg

SEQ ID NO: 146476 - DNA, 633 bp, Homo sapiens
  misc_feature: GYAE6OF02JUC5A.21.4.A04.1.454.CMB.1.raw
  modified_base (482)..(482): a, c, t, g, unknown or other
  misc_feature (482)..(482): n is a, c, g, or t
  modified_base (517)..(517): a, c, t, g, unknown or other
  misc_feature (517)..(517): n is a, c, g, or t
  modified_base (605)..(605): a, c, t, g, unknown or other
  misc_feature (605)..(605): n is a, c, g, or t
  modified_base (614)..(614): a, c, t, g, unknown or other
  misc_feature (614)..(614): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttgggtccacggccgtagggacgggtccccgtggacgtacctctccgtgtgcagcctctgctattcgaccttcacgtcgacctaacaactagtaggtaccgtcgggtacccgctacggcctaccggaacggggagggtcgtcgggaggtcggggtaccggaccgtagttaacgaaggaaacgacgtaaacgagttaacgacgtaacgagaaacgtaccggacgcgtagtagaaggtaaagggacggttacaccagtctagaanaagactgaattaacaaagtactacagtactatacnaacaatagacacgtaccaacgaaaccgagaaccacgggtacctaggtacttgttacggtaagtacgaaagaaagtaggtacggtacgnggttacggnggttacgacgtgtaaccgg

SEQ ID NO: 146477 - DNA, 654 bp, Homo sapiens
  misc_feature: GYAE6OF02IXK5W.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (283)..(283): a, c, t, g, unknown or other
  misc_feature (283)..(283): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgagggaaangccaccctncctgcagctcagccagaatntccagagctacacatagcctgaccagcagacgcctggccaggctccgaggttccnatctatgcgtcggtccacgacgggccaacgtggcctacgtcccgagacgtaggttccaggttcggctagggtcgggtcgtagggacaggtaccttcacgttcacgtactcgtaagttacgccgtacgtacgtcggacgtccgtagtaacgttacgttcggacttagttacgttaaacttacgttcgtacgtaacgtacgtaagttacggttaacgggttaacttaccgtaccgttcgttcggttaccggttaccgggtacccgtaagggttaaccgtaaacgggttaacgtaaaggttaccgggtaaaccgtaacggttaggtacccgggtacgttacgtaacccgtaacggttaccgttcgtttaaccgg

SEQ ID NO: 146478 - DNA, 598 bp, Homo sapiens
  misc_feature: GYAE6OF02HDQJX.21.4.A04.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctggtggagtcgtggggganacttggtccagcctggacgggtccctgagactcctcctgtgcagcctctgcattcaccttcagtcgaccaacaacatcgggactcggggtcccgccgaggcctccgaggggaaggggctgggagtggggtcgccgttattaacgaaggaaagctaaacgagttaacgagtaacaagaactacggcgcgtacaggtagaaaggaggttcaccatctacgaagagatgtatacaaagactcatgtatctgacaaagtacgaacgacgtaccgtaaggaaaacccggaggaacccgtacgggtacccgttagtactttagttcggtaggttaacgaaacggtaaaagtaggtaggtaagtgggttaggtagggtaagtcgtagtacg

SEQ ID NO: 146479 - DNA, 667 bp, Homo sapiens
  misc_feature: GYAE6OF02H07DQ.21.4.A04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagtcgtcgctcgcacgaccggtgctcgatttagagtagtgatcagggagagctgctcagttaggacccagagggaaccatggaaaccccagcgcagcttctcttcctcctgctactctggctcccaggctcagaaccaccggagaaattgtgttgacgcagtctccaggcaccctgtcctttgctccaggggaaangcccacctntccngcagctccagccagatatccagagctactacanacgcctcggtaccagcagaacgccgtggccacggcctcccgaggtttacccnctaactcttacngtcctcgggtccccacgacggggccacgtggtaccactcccgagacgacggttccaagggttcggctagggtcgggtcgtacgggtacacgtacttcctacgtcttccagtcaacgttacgaccgagtaacgtcgggtacggtcctaagggtaacgtacgtttcgacgttaggttacgttaactttaacgttgtacgacggttacgaagtttagtacggtaacggtttccaaaccgtttccggttaggttccggtttacggtacccggaaacggggttaccgtaaagggttaacgtaaacgttaacggtaaaccgtaagtcggttaacggtcgtacgaaccgtactagttcgttaccgg

SEQ ID NO: 146480 - DNA, 771 bp, Homo sapiens
  misc_feature: GYAE6OF02G4705.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanctcccaccctctcctgcagcctccagccaagaactactccagacgctactacatacgcctaggtaccagcaagaacgccgtcggaccacggtcctccccgaggtttccctcacttctatcgcgttcgggtccccacgacggggcctacgtcggacctactacccgaagtaccgtaggttcacggttgggacctagggtcgggttcgtaggggaacctagtacctttccgaccgtttcctacgtacttacgtaacgtttacggacctaaggtaaccggttacgggaaccgtacccgttaaggtaaaacggtttaccgttttaccgggacgttaacgggtttacggtttaacttttaacggttacggttacgtaacggtacgttaacggtttaaggtaacgggtttaaacgtttcccgttaaccgtttcgttacggttacccgggttaccggacccggtaaacggggtaacccgtaaaggggtaaacggtaaacggttaacgggtaaaaccgttaacggttacgggttacggtaccgttaccggaaccgtaaccgttagttacccgttacg

SEQ ID NO: 146481 - DNA, 853 bp, Homo sapiens
  misc_feature: GYAE6OF02IW12Q.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtcgtgggggatacttggtccaggccctgggacgggtcccctggacgacctctccgtgtcgcagcctctgctattccaccttcgagtcgaacccacaacagtacgggactcggggtcccaccgagggcctaccggaagggggaacggggctacggggaggttgggggtaccggtaccggttaagttaaccgaaagggtaaacgtaccttaaacgtacggtttaaaccgaaggttaaccgaaggtaaaacgttaccggggacccggtaccggtttaccgttagggttaacgggaaaaacggggttaacgggtttacccaaaacccgtaagttaccgtaaccggaaaaggtacggtaaacgttcgggtaaactttaccggaaaaacggttaccttacgtaaccgttagttaaactccgttaaggaacctaaaagttacgaaaccgtacgtacccgttaaacgggaaaaacccggtacggggtaaacccgtaaaccggggttacccgttaagggtttaacgtttaacgggttttaacggggtaaccgggtttaaaaccgggaaacgtaaaaaaccggggttgggtttaacggggttaagtttacgggggttaggggttaacgggttacggttaccggttagggttaacccggg

SEQ ID NO: 146482 - DNA, 524 bp, Homo sapiens
  misc_feature: GYAE6OF02H5RCR.21.4.A04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (450)..(450): a, c, t, g, unknown or other
  misc_feature (450)..(450): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctactacatagcctggtaccagcagaagcctggccaggctcccaggttccncatctatgctgggtcccagngggccacgtggcactcccagacaggttcagtcggcaggtggtctgggacagacttcactctcatcattagcagacgtggagccgtagaagtatttcgcgtagtgttattactgtcagcagtagtagtaagttcaccgttntgttccgttcggaccaagggtaacaaggtaagaaagtagaaaacgtacgtgtacgtcgtagcaacgtatcgtcg

SEQ ID NO: 146483 - DNA, 744 bp, Homo sapiens
  misc_feature: GYAE6OF02JNJ26.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaccctctcctgcagctccagccagaatactccagagcctactacatagcctggtaccagcaggaacgcctaggccaggcctccgacggttcctcgactcttagtacgtcgttcggtaccccgacgtacgggccctaacgttgggaccacgtcccgagtaccgtacggttcaggtacggctagggttcgggtacgtacgggaactaacgttaccgttacctacgttacctaccgacgtttacgtaacgtttacgaccgtaacggtaaccggtacgggtaacggtcccgttaaggtaaacgttacgttttccgacggttacggttacgtttacgtttaccgttacggtaccgtacggtaccgtaacggttagtttacgggtaacgtttccgtaccgtttcgtcgggtttacccgttaccgggtaacccggtaacggggtaaccggtaacggtttaacgggtaaacgttaacgggtaaaccgtaaccggttaggtaccgggtacgtaccggtaccggtaccttaccggttacgtttacccgg

SEQ ID NO: 146484 - DNA, 643 bp, Homo sapiens
  misc_feature: GYAE6OF02GCJX2.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccaggggaanagcccaccctctcctgcagcctccagccaagaatactccagagctaactacatacgcctggtaccagcagaacgcctggccaggcctcccgaggttcctcatctatcgccgtcgggtccccacgacgggccacgtcggcactcccgagacctaggttcaggtcggcgtagggtcgggtcgtacggggacaggtacttcaccgttctactatactaagtttacgacgtacggtacgttacgggacgtaccgtaggtaacggttacgttttccggacttaggttagttaactttacgtggttacagtcgtaagttagttaggtaacgtttccacgtttcgttcggttaccggtttacgaccggtaacgggaccgtaaagggtaacgtaaacgtacggaaaacggtacgttaggtacggtccgtacgacctaaccgtacttcgttcg

SEQ ID NO: 146485 - DNA, 725 bp, Homo sapiens
  misc_feature: GYAE6OF02IIZ2Z.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaagacgccaccctctcctgcagctccagccagaatactccagacgctactacatagcctaggtaccagcagaacgccgtggccaggcctcccgtacggttcctacgactctagtcgccgtcgggtacccacggacgggcctacgtggacctacgtcccgagaccgtaggttacaggtcggacgtagggtcgggtacgtacgggacacgtaccttcgacctctctatctagttacgactaagtacgttaggacgtaccgtaggtaacgttacgttacggacgttagtttacgttaacgtttacgtacggtaaccgtacggtaacgttaagggtaacgttacggggttaaacctttcccgtaacccgttttacggttaccgggtttacccgggtttacccggggaaccggtaaaccggggtaaccggtaaacgggtaaacgttaaaaccggtaacgggtaaaacccgttacggttaacgggtcggtaacgttaccggtaacctaaccgtttacgttacgttacccgg

SEQ ID NO: 146486 - DNA, 614 bp, Homo sapiens
  misc_feature: GYAE6OF02IME7F.21.4.A04.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagtcgtcgctcgcacgaccggtgctcgatttagagtagtgatcagggggagctctgagagcggagccccagcccccagaattcccaggtgttttcatttggtgatcagcactgaacacagaggactcaccatggagtttgggctgagcttgggttttccttgttgttattttacaaggtgtccagtgtgaggtncagctggtggagtcgtggggganacgttggtccagcccgtgggacgggtccctggagacctctcctgtgcagcctctgcctattccaccttcagtcgaccacaacagtggtacctggggtcccnccgaggcctacgaggggagggctgggngtgggtcgcgtatacgaaggaanctaagagttaacagtaacgagaacgtacggcgtcgtctaggtagaaaggtacgttaccaacctatcctaacgaagagtagtagaattacgaaaagtactacgtaacgttagtaactctaggaactaaagtacgaacacgacctaacggaaaccgagaaccgacggtaccttaggttattaggtacgtaggtaacgaagtaaaaggtggttaggacgttggtagggtaggtacgtcgtaggtacg

SEQ ID NO: 146487 - DNA, 619 bp, Homo sapiens
  misc_feature: GYAE6OF02GR8F2.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
  modified_base (456)..(456): a, c, t, g, unknown or other
  misc_feature (456)..(456): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctcncctgcagctccagccagaatactccagagctactacatagcctggtaccagcagaacgcctggccaggctcccgagttcccnatctatcggctcgggtacccacgagggccacgtgggaccacgtacccagacgtacggttcaaggtcgggctaaggttcgggtcgtgggaacctaggtaaccttccgaaccgttccgtacgattcctaagtttacgacgagtaccgttgggactccgtaggaacgtntttacggactagttcgttaattacgtcgtacacgtactaggtagttacggtaacttccgtaccgttacgtcggttaccgttacgggaccgtaacgggtaccgaaagggttacgaaagtcgaaacgtacgtggtacggctacggaccacgtacgttacttacgg

SEQ ID NO: 146488 - DNA, 600 bp, Homo sapiens
  misc_feature: GYAE6OF02FIQIT.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaangccaccctctcctgcagcctccagccagaactatccagacgctactacatagcctggtaccagccagaacgcctggccaggcctaccccgaggttccctcatcctatcgtcgtcgggtcccacgagggcccagtcggcactcccaagacgtaggtttcaggttcggcctaggtcgggtctggggacctaggcctttacaccttcactatctattagcgaagcgtggacgtcctagaagtacgtttcggactaggttagttacttacgtgtaccagtcgaaggttagtagggtaagttcctaccttcgttcggtcgttaccggaccgtagggaacctaaggtaaggaaacgtacggaaaacgtaacgtaggtacggtacctagaccaccgtagttcgttacg

SEQ ID NO: 146489 - DNA, 659 bp, Homo sapiens
  misc_feature: GYAE6OF02GKXDD.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaangcccaccctctcctgcagcctccagccagaatactccagacgctactaacatacgcctaggtaccagcaaggaacgcctggcccaggtcctcccgtaggtttcccacatcctatcgcgtcgggtcccagcgggccagtggccactcccgagactaggttcaggtcgcgaggtttcgggtcgtcggggaactacgtaccttcgacttcctacatcgtagttacgcgtaacggtacgtggtacgtccgtaaggaacgttacgttcggacgttagttacgtttacgttacgtggtaaccgaggtacgttaaggttaacgtaggggttaactttaccgaccgtttcgttcggtaccgggttaccggaaccgggtaacgggaaccgttaaagggtaacgtaaacgttacgggaaaaccgttacggtacggttaggcgtacgtacccgtaacgtcgtaccgttcg

SEQ ID NO: 146490 - DNA, 649 bp, Homo sapiens
  misc_feature: GYAE6OF02GUH2I.21.4.A04.1.454.CMB.1.raw
  modified_base (214)..(214): a, c, t, g, unknown or other
  misc_feature (214)..(214): n is a, c, g, or t
  modified_base (469)..(469): a, c, t, g, unknown or other
  misc_feature (469)..(469): n is a, c, g, or t
  modified_base (553)..(553): a, c, t, g, unknown or other
  misc_feature (553)..(553): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttccttgttgttatttacaaggtgtccagtgtgaggtgcagctggtggagtcgtggggganacgttggtccagcctgggagggtccctgagactctcctgtgcagcctctgctattccaccttcagtcgacccacaaacgtgcggacgtcgggtccgccgtaggcctaccggaggggaggggcgtgggaggtcggggtcggcgtaattacgaaaggaaagtactaaactagttaacgagtaacaaggaatacgggcacggtcaggtaggaaagggtacggttaccaacctatcccgtaagtaaaggacgttaagtntaaacttaacggaaaaactccttaactacgttgttaacgttcagtaactaaagtacgaactacgaccctaaacggaaaaccggnggtaaccaaccgggtcgttagttatttacgtagggtaacgttaaggaaaccgtaaaggtggtaggtactgggtaggtagtaggtccgttgaaccgg

SEQ ID NO: 146491 - DNA, 581 bp, Homo sapiens
  misc_feature: GYAE6OF02G6SG9.21.4.A04.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtcgaccacaacagtggactgggtccgccgacggcctccgagggagggctggaggtgggtcgccgtagtacaaggaanctaacagttacagtacagaatcggcgcgtctgtagaaaggtagtcactatctacaagagtatgattacaaagtactacactgactctagacaaagtacgaacacgtacctaacgaaaaccgcggaaccaccgggtaccgtagttacgtttagttacggtaggtaacgaaacgtaaaaggtacggtaggtaacgttgggtagggttacggtaggttgtaggttaacgg

SEQ ID NO: 146492 - DNA, 668 bp, Homo sapiens
  misc_feature: GYAE6OF02GU9KR.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccaagaatactccaagagacctactacatacgcctggtaaccagcagaacgccgtggacccacggtcctccccgacggttccctacgacttctaagtcgtccgtccgggtaccccaacggtacgggcctacgtcggcaccgtacccgaggtaaccgtacggtttaccaagggtcggtacgtaacgggttcgggtacgttacggggacaacgtacttccgtaactccgtactactcgtaacttacggacgaggtacgtcgggtacgtccgtaagaacgttcgtttaccgacgtagttacgttaacgttcgtaggtaccaaggtacttaacggttagtacggttaagttcctaaccgttcgttacgttaccgggtacgaccggtacggtaacgtaagggtaagaacgtacggaaacgtagtcgtagtcgtcgacctactatctacg

SEQ ID NO: 146493 - DNA, 677 bp, Homo sapiens
  misc_feature: GYAE6OF02HH6P2.21.4.A04.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagctccagccagaatatccagagctactacatagcctggtaccagcagaagcctggccaggctccaggttccncatctatcgctcgggtcccacgacgggccacgttcggcctaacgtcccgagacgtacggtttcaaggttcggacctagggttgggtcgtaggggactaaggaccttttcgacgttccttagtaacttcgtaagtttacgacgtaacggtacgttgggactaccgttaaggaaacgttacgtttccgactaggtacgtttacgttacgttagtaccgagtacgtaaggttaagtacggtaaacgtttccgtaaccgttcgttacggttaccggtttaccggaaccggtaacggggtaaccttaaacggggttaaataaacgtaagggtaaaacccgtaacgttcgggttacggtaccgttacgaaccctaaccgtacgttacgttaccgg

SEQ ID NO: 146494 - DNA, 708 bp, Homo sapiens
  misc_feature: GYAE6OF02HQ228.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgctcgaggggaaancgcccaccctctcctgcacgcctccacgccaagaatactccagacgctaactacatacgcctggtaccagcaggaacgccgtggaccaggcctacccgaggttcctacattcctagtcggtccgtcgggtaccccacggacggggaccctaacggtcgggacctaacgtccccgaaaggtaccgtaagggtttccaagggttcggaccgtagggttcgggtcgtacggggaactacggtacctttcgaaccttctaccaactaccgtaagtttacggactaaggtaccgtgggtaccgtaccgtaggtaaacgttacgtttcgacgttagttacgttaacgttacgtgtacgagtacgtaaggttacgtacggtaacgttcctaccgttcgtacggttcccggttaccgaaccggtaacgggaaccgttaaagggtaacgtaaacgttaacggaaaaccgttacggtaggtacggtactaccggacctaaccgttacgttccttaccg

SEQ ID NO: 146495 - DNA, 733 bp, Homo sapiens
  misc_feature: GYAE6OF02GRTVW.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagacgccaccctctcctgcagctccagccagaactatccagacgctactacatacgcctaggtaccagcaagaagcctggccacggcctcccgacggtttcctacgacttctatcgcgttcgggtcccacgacgggcctacgtcggacctacgtcccgaagaccgtacggtttcgagggttcgggtacgggtagggttacgtttacggggaacttagggttacgtttttccgccgttaccacccgtagtccgaacggtcccgtacccgtaagtacggtacgtacggtaaagtacgttggttacgtactttagttttacgtttcgtacgtacccgtagtaactaaagttaacgtttaacgttacgttacggtcccgttacggttacccggttaccggttaaccgggtttaccggaacccggtaaccggggtaaccggtaacgggttaacggaaacgtaaccgtaaaaccggtacgttacgggttaccggtactacggacccgtaaccgtacgtttaccgttacggttaccttaccg

SEQ ID NO: 146496 - DNA, 699 bp, Homo sapiens
  misc_feature: GYAE6OF02GH6F9.21.4.A04.1.454.CMB.1.raw
  modified_base (201)..(201): a, c, t, g, unknown or other
  misc_feature (201)..(201): n is a, c, g, or t
  modified_base (239)..(239): a, c, t, g, unknown or other
  misc_feature (239)..(239): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccacctctcctgcagctccagccagaatactccaganctactacatacgccttaggtacccagcagaacgccgtggccaagggtcccttccccgagggtttccctacgtacttcgtatcggaccgttcggggtacccctacggacggggccctaacgtcgggacctaaccgttcccgaagaccgtaggtttaccgagggttcggacgtagggttcgggtactaggggactaacggtcctttaccgacttcctacgtactactaacgttacggacctaggtaccgtagggaccgtccgtaaggtaacgtacgtttaccggactaggtttacgttaacgttacgtagttacgacgtacgtagttacgtaggtacgttctaccgttcgttcggttaccgttaccggaaccgtacgggtaaccggtaaggttaacggtaaagtaacggtaaaccgtacgttcggtacggtacgtcgaaccctacgttactaccgtttacgg

SEQ ID NO: 146497 - DNA, 569 bp, Homo sapiens
  misc_feature: GYAE6OF02FJBWB.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatatccagagctaactacatagcctggtaccagcagaagcctggccaggctcccaggttcctcatctatgctcgggtcccagcgggccacgtggccatcccgagcgtaggttcaggtggctaggtgggtctgggacagtacttcactctacatcattagcagactggagcctagaacgtactttcggactagttcgtattacgtgtacagctagttacgtaggtaagttcctaccgttcttcggttaccgttaccggaccggtaacgggtaaccgtaagggttaaacggaaactacggaaacgtaacgtaggtacggtctagaccgacctacgtcgttacg

SEQ ID NO: 146498 - DNA, 507 bp, Homo sapiens
  misc_feature: GYAE6OF02GUK6A.21.4.A04.1.454.CMB.1.raw
  modified_base (197)..(197): a, c, t, g, unknown or other
  misc_feature (197)..(197): n is a, c, g, or t
  modified_base (329)..(329): a, c, t, g, unknown or other
  misc_feature (329)..(329): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctcaggggaangccacctctcctgcagctccagccagaatatccagagctacacatagcctggtaccagcagaagcctggccaggctcccgaggttcctcagtctatgctcgggcccagacgggccacgtggcatcccagacnggttcagtggcaggtggtctgggactagtactcactctnatcatgactagacgtggacgcctagtaacgtntttcggctagttacgtattacgtgtcaggctagtataggtacttcacttgtagttcgtcgacgaggactaggtagaatagaacgtagtgtacgctgactctatntcg

SEQ ID NO: 146499 - DNA, 702 bp, Homo sapiens
  misc_feature: GYAE6OF02I5JSV.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagacgccaccctctcctgcagctccagccagaatactccagagctactacaactagcctggtaaccagcaaggaagccgtggccgaggcctcccaggttccctacactctagtggtccgtcgggtacccacggacgggaccacgtcggccacgtccccgaaggtaccgtaacgggttcaacgggtcgggacctagggttcggggtcgtaggggaccgtaaggtaccgttccacgttcctactacttacgtaactttaacgccgaaggtaccgtagggtacgtccgtaaggtaacgttaagttttaccgacgttaggtttagttactttaacgtggtacgacggtacttaggttacgtaaggttaaccggttctaacccgttcttacgggttccgttaccggaaccggtaacgggtaaccggtaaagggtaaggtaaaacttacgggaaaaccggttcgttaacgggtacggtactacggtacccaccgttacgtccgtttacg

SEQ ID NO: 146500 - DNA, 675 bp, Homo sapiens
  misc_feature: GYAE6OF02FGSHE.21.4.A04.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccacctctcctgcagctccagccagatnccagagctactacatagcctggtaccagccagaacgcctggcccaggcctcccgaggttccctcactctatgcttcggggtccccagacgggccacgtgggcacgtcccagacctacggttacacggtcggctagggtcgggttcctaggggaacctaggtacctttcaccttcctcacttcctaattacggctagtaccgttgggacgtcccgttaggaacgtagtttaccggacgtaaggttcgttaactttaaccgttggtaccgaaggtccgtaaggtttacgttacgggttaaacgttttccaacccgtttcgttcggttaccggtttaccgggaacccgtaagggaacccgtaaagggtaaacggtaaacgttaacgggtaaaaccggtacgtttagggtacggtaccgttacggaaccctaaccgtacgtttccgttaccg

SEQ ID NO: 146501 - DNA, 555 bp, Homo sapiens
  misc_feature: GYAE6OF02G5BR3.21.4.A04.1.454.CMB.1.raw
  modified_base (280)..(280): a, c, t, g, unknown or other
  misc_feature (280)..(280): n is a, c, g, or t
  modified_base (383)..(383): a, c, t, g, unknown or other
  misc_feature (383)..(383): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccaggcctgggagggtcccctgagactctcctgtgcagcctctgcattcaccttnagtgaccacaacatggactgggtccgccaggctccgagggaagggctgggagtgggtcgccgtatacgaaggaagctaacagttacagtacagaactacggcncgtctgtagaaaggaggttcaccatcacgaagagatgattacaaagaactcactgtatctgacaaatgaacagcctaagaaaaccgaggaccacggccgtagtagttagttggtaggtaacgaacgaaaaggtacgtaggacgttgggttaggtaggtaggtcgtagtacgg

SEQ ID NO: 146502 - DNA, 839 bp, Homo sapiens
  misc_feature: GYAE6OF02JQBD6.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccggagaaattgtgttgacgcagtctccaggcaccctgtctttcgtctccaggggaaanactccaccctctccgtgacacgctccagccagtaactactccaagacgtcctaactacattacgccttgggaccaggaccaaggaacgtccgtgggtacccaaggcccttaccccgagggttttcccaccgtaattccgttaacgtcgccgttaccggggtacccaccggtacggggtcccaaccgttgggacctaacgtccccgaaggtaaccttacgggttccctaaggttcggtacccgtaaggggtttcggggttacctacggggaaacctaacgggttacctttaccgacgtttcccttagtaacgttaccgtaagtttacgtaccggtacggtaaccgttagggtaaaccggccgttaagtaaccggttacgtttacggcttaacggtatttacggttactacggtacgtacgtaccgttaaggtaacgtttacgggaacgttttcctaaacccggtttcgttacggtttaccggttaccgggtaacccggtaccgggttaaacccggtaaagggttaaaacggttaaaccggtttaaacggtaaaaacccggttaaccgggtttacggttaaccggtaccgggttaacccgtaacccggttaaaccgttaccggtttaccgttttaaccggg

SEQ ID NO: 146503 - DNA, 645 bp, Homo sapiens
  misc_feature: GYAE6OF02GW4QN.21.4.A04.1.454.CMB.1.raw
  modified_base (494)..(494): a, c, t, g, unknown or other
  misc_feature (494)..(494): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccagccgtggacgggtccctgagacctctcctgtgcagcctctgctattccaccttcagtcgaccaacaacagtcggacgtcgggtcccgccgaggcctaccggaggggaacggggcgtgggtaggtcggggtcggaccgttaagtaacgaaaggaagactaacagttaacaagtaacagaagtcggcgtcgtgtagtaggaaaggtacgttaccacctatcgtacaagagatacgataacgaaagtactactaacttgtaactcgtanataaagtacgaacgtacgaaccctaacggaaaacccggtaggaaccctaacgggtccggttattacgttttagttagggtaacggttaaacgaaacgttaaaaggcgggttaggtaagttggggttagggtaggtacggtacgtgggtacg

SEQ ID NO: 146504 - DNA, 679 bp, Homo sapiens
  misc_feature: GYAE6OF02JUMKT.21.4.A04.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (521)..(521): a, c, t, g, unknown or other
  misc_feature (521)..(521): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagcccagaatctccagagctactacatacgcctggtaccngactagacnccgtgccaggtcctacccgacggttccctcgacttctagtcgccgtcgggtccccagacgggcctacgtggactacgtcccgagacgtcggttacacggtggaccgagggttgggtcgtagggaactacggtcctacgtactctacgacttacgtacgttacgacgtaacggtacgtacggtacgtacccgtaggtaaacgttacgttaccggacgtagttacgttaactttacgtacgtcgtaacggtntacggttagtacggttaacgttacctaccgttcgtcggttaccggttaccgggtaaccggtacgggaacccgttaaggtaaacggtaacgtaacggtaaacggtacgttacgggtacggttaccgtaccggtaacctaccggtacttaccggtaccgg

SEQ ID NO: 146505 - DNA, 742 bp, Homo sapiens
  misc_feature: GYAE6OF02IWDSX.21.4.A04.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggaccagagggaaccatggaaaccccagcgcagcttctcttcctcctgctactctggctcccaggctcagaaaccaccggagaaattgtgttgacgcagtctccaggcaccctgtcttgtctaccgagggaagngccacctctcctgcagcctccagccaagaatactccagacgctacgtacatagcctggtaccagcaagacgcctcggccaggcctaccgtaggttccncactctagtcgcgtcgggtacccagacgggcctacgtggaccatcccgagtaccgacggtttcgaggttcgggactagggttcgggacgttagggaactacgtcctttaccgacttcgtcctaatctagttacgcgtaacgtagtcggacgtacgtacgaacgttgttaccgacgttagttacgttaacttacgtacgtacggtaagtcccgttaaaggttacgtacggggttaaccgtttacccgtaccgttttaccgttaacccggtttccgggttaacccggggtacccgttaaacggggggttaacccgtttaaaggggttaaaacccggttaaacggttaaacggggttaaaacccggtaccggtttacggtttaaccgggtacccggtttaaaccggaccccgttaaaccccgttagggtttaccccgttttaaaccgg

SEQ ID NO: 146506 - DNA, 723 bp, Homo sapiens
  misc_feature: GYAE6OF02IJ2PN.21.4.A04.1.454.CMB.1.raw
  modified_base (255)..(255): a, c, t, g, unknown or other
  misc_feature (255)..(255): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctgctcccaggctcaagaaaccacggagaaattgtgttgacgcagtctccgaggccacccgtgttctttcgtctaccgaagggaaagcgcccaccctctcctcgcacgcctaccacgccaagtaactactaccaggnaccttaacacatacgcctaggtaccagacacggaacgccgtcggaccacggtccctaccgtacggttccctacgttaaccgtttacccgtgactacctacccaacccgacggccccgtacgtcggtccgtacccgaggtaccgtacggttacgaggttcgggcggtaggttaacggtttgggaacttacgttacgttttccaccgtaacctaccattaccgacgtcccgtaacccgtacgtacggtaagtacggtaagtacgttcggttacgtagttaacgtttttacgtcacggtaacctagtaactaaacgttaaattaacgttaacccgtcggttaccgtcggttacccgtaggtaccccgggttacgtaccgaaacggggtaaccgtaggtaacgaaacgttacgaaaccgcggttagtccggacttcgacctacgtattccgtcggttcctactacgttcccg

SEQ ID NO: 146507 - DNA, 804 bp, Homo sapiens
  misc_feature: GYAE6OF02IJNBA.21.4.A04.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttcctgttgttatttacaaggtgtccagtgtgaggtgcagctggtggagtcgtggggganacgttggtccagcccgtgggacgggtccctgacgactccgtcctgcgcgacgccctgtcgactattccaccttccaggttaccgaaacctaaccaaaccgtagttcgggtaaccgttcgggggtccccgaccgaacgggtcctaaccccgggaaggggaacgggggtcctaggggaacggttcgggggtaccggtaccgttaagttaaaccggaaaggtaaacgtacctaaacggtaacgtttaccgaaggttaccgaaacggtaacgtaaccggcgtaccgggtcctaagggtacggtaaaaacgggtacggttaccaacccggtagttaacctaacggaaaggtacgtaacgtaggtaactttaaacggaaaacgtaaccgttacgaacgttagtacttacgaaacgtaactaaaacggtacgaaaccgtacggtaaacccgtaaacggaaaaacccggagggtacccgaaaccgggtccgtttaacggttaacttaagggtttacggtaaacgggttaaaccgaaaccggtaaaagacggttggaaggttaacggttggggtaacggtaacgttgtacggttaaccgg

SEQ ID NO: 146508 - DNA, 632 bp, Homo sapiens
  misc_feature: GYAE6OF02G6UFV.21.4.A04.1.454.CMB.1.raw
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaancgccaccctctcctgcagctccagccagaatatccagagctactacatacgcctggtaccagcaagaacgcctggccaggcctcccgaggttccctnactctatcgctcgggtcccacgcgggccacgtggaccactcccagaccgtaggttcaggtggctaggtggtctgggacagtacttcactctacatactattacgactaacgtacgtcggacgtcctaaggaacgttactttcggacgtaaggttacgttaattacgttgtaccgtagtacgtaagttagttacggtaacgtttacctaccgttgtacggttaccggttaccggaccggtaacgggaccggtaaacggtaacgtaaacggtaacggaaaaccggtaacgttagggtacggtaccgtacggaacccgaaccgttactaccggttacg

SEQ ID NO: 146509 - DNA, 631 bp, Homo sapiens
  misc_feature: GYAE6OF02F898N.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaanagccaccctcctcctcgcagctccacgaccacgaataatccacgagctactacatagtcctggtaccacgcacgaagacctcggccgaggctccccgagttccgtcatctatgcgtcgggtccacagggccactggcactcccacgacacggttcagtggcgagtggggtcgtagggacgacgtacttcactctcagtacacgttacgcgagtacgtggagtacctgaacgtacgtttcgacacggttagttacttacgtgtacgaacgcgaacgttagtagggtaaacgtttccgtaccttcccgttagggtttacgttacccggggaccgaacggggtaaccgaaacggggttaaggtaaaactaacgggtaaaaccggtaacgttaggtacgggtactaccgggactaacccgttagtccgtttacgg

SEQ ID NO: 146510 - DNA, 660 bp, Homo sapiens
  misc_feature: GYAE6OF02I3JEO.21.4.A04.1.454.CMB.1.raw
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaaancgccaccctctcctgcagcctccgagccagaaatactccagacnctaactacatacgcctggtaccagcagaacgcctggccaggcctccgtacggttccctcactcttatcgcgtcgggtcccacgacggccacgtcggcactacccgtaagaccgaggttccaggtcggacgtaggttgggtcgtcggggaactacggtacttcactctacacgtctaagttacgacgacgtacgtggacgtacgtagtaacgtacgtttcgacgtagttcgttaacttacgttcgtacgtagtcgtaagtacgttaggtaacttcctaccgtttcgttacggttacggttaccggaccggtaacggggtaaccgtaaagggttaacgtaaaacggttaacggaaaaccggttaacgttacgggtacggtacgtaccgaccgtaacccgttacgttcccggttacg

SEQ ID NO: 146511 - DNA, 624 bp, Homo sapiens
  misc_feature: GYAE6OF02F39CE.21.4.A04.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagccgtggagggtccctgagactctcctgtgcagcctctgcattcaccttcagtgaccacaacatggactcgggtccnccgaggcctccgaggggaacggggctgggaggtgggtcggccgtaattaacgaaggaaacgctaaacagttaacagtacagaatacggcgacgtctgtagaaagggaggttccaaccgtatcctacgaaaggactaagtgaattacaaaagtaacctcaacttgtactctaggaaccaaaagttcgaaactagtacccgtaaggaaaaacccgaggaccacgggtaccttaggttactttaagttcggtaaggtaagaaaacgtaaaacggtaggttacggtagttagggttacgggtagggttaacgcgttaggtaccgg

SEQ ID NO: 146512 - DNA, 687 bp, Homo sapiens
  misc_feature: GYAE6OF02HCGKN.21.4.A04.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcttgtctccgagggaangccaccctctcctgcagctccagccagaactactccagagcctacacatagccgtaggtaccagcaagaacgcctcggccaggcctacccgaggttccnctattcctagtcggccgtcgggtaccccacgtacgggcctaccgtggcctacgtccccgaaggtaccgtaggttacaggtcggacgtacgggttgggtctacggggactacggttaacctttccgaaccgttctcctaattacctagtttacgacgtaacgtacgtacgggaccgtacgtacggtaaagtacgtttacggactacgtttgtttaacttactcggtacacggtcgaagtttacgtaggttaacgttaccgtacgttaccgttgttcccggttaccggaaccggtaacgggaacccggttaagggtaaacgttaaacggtaaccggtaaaacggtaccggttagttacgggtacacggtacccgtaacttagtccgttaccg

SEQ ID NO: 146513 - DNA, 730 bp, Homo sapiens
  misc_feature: GYAE6OF02H0LVU.21.4.A04.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccacctctcctgcagctcagccagaatatccaagngctactacatcgcctaggtaccagcagaagcctggcaggcctccgacggttccncattcctatcgacgtcgggtccccagtacgggccctaacgtcggccacgttccccgaaggaccgtacggtttccgaggtcgggtacgtagggttggggttacgtggggtaacacggtaactttccgaccgtcctactacttactacgtttaacgaccgtaaggtaccgttagggacgtaccggttacggaaacggttacttttaccgggacctttaaagggttacgttaacgttttacgtcggtacgtaagtaccgtaaggtttaacgtacgggttaacgtttacccgttaaaccttcgttacggttaaccggttaccgaaaccggtaacggggtaaacccggtaaagggtaaaccgtaaacggtaacgggtaaaacccggttaacgttggggttacggtacgtaccggttacccaacgttaccgttgtttaacccgg

SEQ ID NO: 146514 - DNA, 542 bp, Homo sapiens
  misc_feature: GYAE6OF02GO9RA.21.4.A04.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaangccacctntcctgcagcctcagccagaatatccagagctactacatagcctggtaccagcagaagcctggcaggctcccaggttccnatctangctggtacccanacgggccacgtggcactccagacagttcagtgcaggtggtctggacagcttnactcnatcatagcagacgtggacgccgtagaagtactttcgactagttagtacttacgttgtactagacagttagtaggtacttactacgtcttaggttaccgttcggaccgtaacggaccgtaaggtacgaaagtcggaaaccgtacgtaggtacggtacgtcgaccgtaccgtacgtcgttacg

SEQ ID NO: 146515 - DNA, 675 bp, Homo sapiens
  misc_feature: GYAE6OF02FI494.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccaccctctcctgcagcctccagccaagaatctccagacgctaactacatacgcctaggtaccagcagaacgtcctggccaggtcctcccgaggttccctcatcctatcggcgtccgggtaccccaggacgggccctacgtcgggacctacgtccccgaggtaccgtaggtttacgaggtcggactaggggttcgggtcgtaggggaacctaggtaccctttaccgaccgttcctacgactacgtaagttacgacgtaacgtacgtaggacgtaccgtaggtaacgtacgtttaccgacgtacgttagttacgttacgttaggtcgtaacgtacgtagttagtacggttaacgttccgtaccttcgttacgttccggttaccgggaccgtacgggtaacgtaaggtaacgtaaacgtaacggtaaacgtaacggtaggttacggtacgtacgacgtacctagttacgttacg

SEQ ID NO: 146516 - DNA, 630 bp, Homo sapiens
  misc_feature: GYAE6OF02I9T7P.21.4.A04.1.454.CMB.1.raw
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaangccacctctcctgcagctccagccagaactatccagagctactacatagcctggtaccagcagaacnccgtgccaggctcccaggttcccncatctatcgcgtcgggtcccacgagggcccagtcggccactccccgaagtaccgtaacgggtttcaacgggttcgggacctaggggtttacggggttccgtgggggaaccacggtaaccttttccgacctttccgtacctaatccgtaagttacggactaaggtacgtacgggacgccgtagtaagtctttcgactagttgttacttacgtgtacagctaaggtagtaggtaacgttcctacctcgttcggtccgttacggaccgtaagggaacctaagggtaacgtaagtaacggaaacgtacgttggtacgtacgtacggacctacgtacgtcttcg

SEQ ID NO: 146517 - DNA, 583 bp, Homo sapiens
  misc_feature: GYAE6OF02GMP9M.21.4.A04.1.454.CMB.1.raw
  modified_base (300)..(300): a, c, t, g, unknown or other
  misc_feature (300)..(300): n is a, c, g, or t
  modified_base (497)..(497): a, c, t, g, unknown or other
  misc_feature (497)..(497): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactgggtccnccaggcctccgaggggaaggggctgggagtgggtcggccgtatacgaaggaaagctaaacagttacagtacagaatacgggcgcgtctggtagaaagggtaggttccaaccgtatccgtacaagtacgataggaattcgaaaagtaactacaacttgtaactctagacaaaagtgaaactagacctaagaaaaccgnggaaccacgggtccgtagtacttagttggtagggttaaacacgaaaagtggtaggtagtggtagggtaggtacgtcgttagtacgg

SEQ ID NO: 146518 - DNA, 632 bp, Homo sapiens
  misc_feature: GYAE6OF02IWDVG.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaanacgccacctctcctgcagctccagccagaatactccagagctactacatacgcctggtaccagcagaacgccgtggccaggtcctaccccgtagggtttccctcacttctagtcgtccgtcgggtacccacgtacgggccacgtcggccactcccagaccaggttcgaggtggcgtaggtcgggtcgtacgggaactcggtacttccgtactcctctactacaagttacgacgtaacgtcgtaggacgtacgtaggtaacgtacgttacgcgtaggttattacgttaactcggtacgagtacgttaggtacgttaggtaacgttcgtaaccgttcgtcgttccggtaccggtaccgtacgggtacgtaacggtaagtaactaacggaaacgtacgttaggtacgtacgtacgaccgtaacgtcgtacgttacg

SEQ ID NO: 146519 - DNA, 691 bp, Homo sapiens
  misc_feature: GYAE6OF02IPDWJ.21.4.A04.1.454.CMB.1.raw
  modified_base (216)..(216): a, c, t, g, unknown or other
  misc_feature (216)..(216): n is a, c, g, or t
  modified_base (482)..(482): a, c, t, g, unknown or other
  misc_feature (482)..(482): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggtttccttgttgttattttacaaggtgtccagtgtgaggtgcagctggtggagtcgtggggganacttggccagcctggacgggtccctgagactctcctgtgcagtcctctgctattccacctttcagtcgacccaacaaactagtcggacgtcggggtacccgccgacggcctaccggaagggggaacggggcgtaggggacgggttcggggtccgggaccgttaagttaacgaaagggtaacgaccttaaacgacgtttaacgaagtaacgaaggtaaactacgggcgtcgtactaggtaaggaaagggtacggtttaccaaacctntacgtacaaaggtacgaattagaacttaacgaaaaggtaccctacaacgttgttaaactcgacgtaacaaaagttagaaacccagtacccgtaaacggaaaaacccgtgggaaccctaacgggggtccttaagtatttagtgggtaaggtaaacgaaacgtaaaaggtcggaggtaagttcgggttaggtagggtaactcgttggaacg

SEQ ID NO: 146520 - DNA, 698 bp, Homo sapiens
  misc_feature: GYAE6OF02IPPNF.21.4.A04.1.454.CMB.1.raw
  modified_base (306)..(306): a, c, t, g, unknown or other
  misc_feature (306)..(306): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgttgacgcagtctccaggcaccctgtctttgtctccgaaggggaaagagcccaccctctccgtgcagcctccagccagaatatccagacgctaactacatagcctggtaccagacaagaacgcctcggaccgaggcctccccgaggttcccnctaacttctagtcggtccgtcgggtccccacggaccgggcccacgtcggcctaccgtcccaagtacgacggttacgaggtcggacgtagggttcggtcgtaggggacacgttacttccgacttccgtntactacgtattacgcagtacgtggtacncgttaggaacgtacgtttcgacgttagttacgttacttacgtacgtagtacgtacgttagttaacggtagttaaccgttccgacccgttcggttacggttaccggttcccgggaaccggtaaccgggtaaccggtaaagggtaaacccggtaaagttaaccgggtaaaccgtaaccggttagggttaccgggtaccttaacggtacccgaacccggttagttacccgtttaaccgg

SEQ ID NO: 146521 - DNA, 710 bp, Homo sapiens
  misc_feature: GYAE6OF02IK2HC.21.4.A04.1.454.CMB.1.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagttggctgagctgggtttcctgttgttatttacaaggtgtccagtgtgaggtgcagctggtgagtcgtggggganacttggtccagcctggaggtccctgacgactctcgtgtncagcctntgactattcaccttcagtcgaccanaacntggactgggtccncgaggctcgaggaggctggatgggcncgtatacgagaanctaacngttacagtacgaagtaacgtacggctacgtcgtagtacggtaaaagggtacggtttacaaccctaagtccgtaacgaaaggtacgacgttaggaacgtttaacgaaaaggtaaccttaccgtaacgttattaacgtacctagggtaaacctaaaacggttcgaaaaccgtacggtacccgttaaaggaaaaacccgtagggtaaacccgtaaacccgggtaccgtttacggttaaacttttaacggtttacgggtaaccggtttaacggtaaaaccggtaaaaaacgggtttaccggtaagggttaaccggtttaagggttccggggttaaacgggtttacgtacccggttagggtttaaaccccggg

SEQ ID NO: 146522 - DNA, 675 bp, Homo sapiens
  misc_feature: GYAE6OF02FG393.21.4.A04.1.454.CMB.1.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
tcagtcgtcgctcgcacgaccggtgctcgatttagagtagtgatcaggggagagctgctcagttaggacccagacggagccatggaagccccagcgcagcttctcttcctcctgcttctctggctcccagacaccactggagtgattgtgatgacgcagtctccagccaccctgtctgtgtctccaggggggancgccacccgtctcctgcacagccagtcagtctatcgctgactggttancctggtaccagcagaatctggccaggctcccgaggcctcctactacttttacccgtgcctaactcccgaaccgacggggccctaacgttggggtactaccccaaggtaccgtaagggttccaggtgggaccggtaggtacgtttagggtacgacgttagttttccttcgtcctacctactcgacgcgtcccctactacgagtagaagtacgtagtagtcgtacgtttagtttcttgtacctacgtaccgtaaattaacgtaaactttacgttaacggttaccgttcggtaccgttaccgtacggtttaccgggaaccgttaaccggggtacccaaacggggttaccggaaaacggttaaccgtaaaaccggtaaccgtaacggtaacgggttacgtacggtacccgaccgttaccgttaccgttcgttaaccc

SEQ ID NO: 146523 - DNA, 616 bp, Homo sapiens
  misc_feature: GYAE6OF02HYANU.21.4.A04.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtcgtcgctcgcacgaccggtgctcgatttagagtagtgatcaggggaggagctgctcagttaggacccagagggaaccatggaaaccccagcgcagcttctcttcctcctgctactctggctcccaggctcagaaaccaccggagaaattgtgttgacgcagtctccaggccacctgtctttgtctccgaggggaaancgcccacctctcctgcagctccacgccagtaatactccaagagcctaactacagtacnccgttacggtaccagacaagtaacgccgtaggacccaggccctacccgtacggttacccactacttacgttagtcgtaccgtacgggtaccccacgacgggcctacgtgactactccgaagtacgtacggtcgagtcgactaggtggtcgtgggactagtacttcacgtctctatactaattacgacgtacgtactaggactacgtagtaacgtagtttacgacgtagttagttacttctgtacgacgtacgttagtacgtagtactacgttactcgtggtaccgtacgacgacggaccgtaaaggtaataacgtagtaaacgtacgtaggtacgcgtacgactaacctctgtacg

SEQ ID NO: 146524 - DNA, 727 bp, Homo sapiens
  misc_feature: GYAE6OF02H8D2Q.21.4.A04.1.454.CMB.1.raw
  modified_base (690)..(690): a, c, t, g, unknown or other
  misc_feature (690)..(690): n is a, c, g, or t
  modified_base (721)..(721): a, c, t, g, unknown or other
  misc_feature (721)..(721): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggtttccttgttgttattttacaggtgtccagtgtgaggtgcagctggtggagtcgtgggggagacttggtccaggccttgggacggggtcccctggacgactctcctgtgcagcctctgcatttcacctttcagttcgaaccaacaaacctatcgggtaacctgggggtccgcccgaagggcctacccggaggggtaacgggggctaggggacgggttgggggtccggaccggttaagttaacgaaacgggaaacgtaccgttaaacgaacggtttaaccaaggttaaccgaaggtaaacgtaaccggggcgtacggttaccttaggtagggtaaaacgggtaacgggtttaccaaacccgtacgttaccgtaaccgaaaggtacgtaattacgggaaatttaccggaaaaacgtaaccgttcaaaccgttgtaacttcgtaagtaccaaaagtcggaaaccagtacccgtaagaaaacccggaggaccaacgggtccgttatagtttaacgttggtaacggtagaaaccgtaaaggnggttacggagttcgggtaggttggtagtcgnggtacg

SEQ ID NO: 146525 - DNA, 658 bp, Homo sapiens
  misc_feature: GYAE6OF02HS5XT.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctcctgcagcctcccagccagaatactccaagagctaactacatacgcctaggtaccagacaagaacgccgtggccacggcctccctaggttccctcactctagtcgcgttcgggtacccaggacgggccacgtggaccactccgaacgacgtaggttccaggtcggacctaggtcgggtcgtaggggactagtacttcaccgtctaccagtacaagtttacgaccgtaagtacgtggacgtcgtaggtaacgtattacgtacgtagttgtttaacttacgttcgtacgagtacgtaaggttacgttacgggtaacgtttaccgaccgttcgttacggttaccggttacgggtaaccggtaacgggtaccgtaaagggtaacgtaaacgtaacggaaacggtaacggtaggttacggtacgtacggtaccacgttactacgttacg

SEQ ID NO: 146526 - DNA, 843 bp, Homo sapiens
  misc_feature: GYAE6OF02JVTI5.21.4.A04.1.454.CMB.1.raw
  modified_base (146)..(146): a, c, t, g, unknown or other
  misc_feature (146)..(146): n is a, c, g, or t
  modified_base (198)..(198): a, c, t, g, unknown or other
  misc_feature (198)..(198): n is a, c, g, or t
tcagtcgtcgctcgcacgaccggtgctcgatttagagtagtgatcaggggaggagctgctcagttaggacccagagggaaccatggaaaccccagcgcagcttctcttcctcctgctactctgctcccaggctcagaaccaccganaaattgtgtgacgcagtctccaggcaccctgtcttgtctccgaaggggtaanagtcccaccctctccctgccaagtcctcccagccagaaatctccgagtagctaactacattacgcctggtaccagacgagaagcctcggaccgaggcctaccccgtaggttccctacctataccgttaatcggaccgttaccggggtaccccaaccgtacggggggtcccctaaccggttcgggaccggttaaacccttccccccgaaacgggttaacccgtaccggggttttacccgtaaacgggttcccggggaaccgtaacggggtttacggggggtccgtttacggggaaaccccggtaaggttaccccggttaaccaccgtttcccggtacccgttataccgtaagttaccggtacgaaccgggtaaccgttcggggaactcccggttaaggaacggttacgttttccggtaacgttacgttacggttaccgttaacgttcgtaaccggtagtccgtaagttaccggtaaggtaaccgttccgtaacgtccgttacggttaaccggtaccgggtaccgtaacgggtaaccggtaaacggggttaacctaaaaggtaccggtaaaaaccgggacctttacgggggttaaccgtacggttacccgggtaactaaccccggtttactacccgggtttacccgg

SEQ ID NO: 146527 - DNA, 736 bp, Homo sapiens
  misc_feature: GYAE6OF02G5L6F.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccaggcccgtgggacgggtccctgagactctcctgtgcagcctctgctacttccaccttcagtcgaccacaacagtggactcgggtcccgccgaggtcccgtaccggaggggaacggggtcgtggggagggttcgggggtccggtccggttaagttaacgaaaagggtaaacgaccgtaaacgtacggttaactaacggtaaacaacggtaaacgtaaccgggcgtacggttcgttagggtaagggtaaaacgggtacgttaccgaacccgtaaagttccgtaacggtaaagagtaagttacggtaacgttaacgaaaacggtaactaccgtaacgttacggtaaacttcctacggtaaactaaacgttgaaaaccgtaccgacccgttaaaacgggaaaaccgtaccggggaaccgaacgggttcctaacggttattttacgtaggtacggtaaagaaccgtaaaggtacggtaggtaagtcgggttaggttacggtgtcggttggtaacgg

SEQ ID NO: 146528 - DNA, 659 bp, Homo sapiens
  misc_feature: GYAE6OF02F3E9B.21.4.A04.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctcgaggggaangccacctctcctgcagctccagccaagaatactccgagagctaacacatacgcctggtaccagcaaggaacgcctaggccaggtcctacccgacggttccctacgaacttcgtatcggccgttcggggtaccccacggacggggccccaacgttcgggactaaccttcccgaagaccgtacggttacgaggttcggactagggtcgggtcgtgggacagtacctttcaaccgtctacattacgattacgccaagcgtaggactccgtaagaagtactttcgacgtagttagtaactttacgtgttacgacgtcgtaagtacgtacgggtaacgttccgacgttcgttacgttaccgttaccgggtaccgaacgggtaaccgaaaggggttaacgtaaacgtacgggaaaaccgtagttacggtacgttaccgtaccgtacgaaccgttacgtcgttaaccgg

SEQ ID NO: 146529 - DNA, 587 bp, Homo sapiens
  misc_feature: GYAE6OF02GAL16.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagngccacctctcctgcagctccagccagaatatccagagctactacatagcctggtaccagcagaacgcctggccacggctcccaggttcctcgatctatcgcgtcgggtcccacgacgggccacgtcggctactcccagacgtaggttcagtgacgagtcgggtctgggacagtacttcgactctcatcatagcagacgtggacgtcgtagagtattcgagtagttacgttacttacgtgtcgacgtcgtagttacgtaggtaacgttcctaccgttcgttacggttccggttaccggaacggacgggtaaccgtaagggtaacggtaaacgtacggtaaaccgtaggttaggtacggtacgtacgtacgtaaccgtagtcgttacg

SEQ ID NO: 146530 - DNA, 638 bp, Homo sapiens
  misc_feature: GYAE6OF02GLSQO.21.4.A04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaangcccaccctctcctgcagctccagccagaatctccaganctactacatacgcctggtaccagcagaacgcctggcccaggcctcccgtaggttccctcgactctaatcggcgtcgggtcccacgacgggccacgtggcctactacccgagaccgtaggttcaggttgggctagggttgggtctaggggactaggtacctttcgacctccgtcaactctaacgtttacgacgaacgtacgtgggacgtccgttagggtaagtacgtttacggacgtacgttagttacgtttacgtgtacgagtacgtaaggtagttaggtaacgttaccgtccttcgtcggttcgttaccggacggtaccgggtaacggtaacggtaagtaaagttacggaaaaccgtacggttacggtaggtccgtacgaccaaccgtacgtacttaccg

SEQ ID NO: 146531 - DNA, 488 bp, Homo sapiens
  misc_feature: GYAE6OF02GUYWJ.21.4.A04.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagctccagccagaatatccagagctactacatacgcctggtaccagcagaagcctggccaggctccccgaggttccnatctatgctgggtccccacgagggccactggcatcccagacaggttcagtgcagtgggctgggacngacttcactctcatcattagcagactggagcctgaagatttcgctagtgtattactgtcagcagtatggaagttcactctgtcgtcgccaggacaaggtagaatagaacgagtgnggctgcacntntcg

SEQ ID NO: 146532 - DNA, 702 bp, Homo sapiens
  misc_feature: GYAE6OF02GQ436.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctggtggagtcgtggggganacgttggtccagccgtggacgggtccctgagacctctccgtgtcgcaggcctctgctattccaccttcgagtcgaaccacaactataggactcgggtcccgccgacggcctcggaagggaaggggcctagggacggtcgggtcggccgttagttaacgaaggtaaacgactaaacgagtttaaccgagtaacaaggaaactacgggcgtacgttcgtagggtaagaaagggtaacggttacgaaccgaattaccgtaacgaaacgaagaacgttaggaacgttaacgaaaagttaaccgtaccgttaacgttacgtagttacctacgacgtaaaactagaaactacgaccgttaacggaaaaaccgtacgggaaaccaacggtccgttaaggaactttacggtttacggtaacgggttaaagaaaccgtaaaaaggtaggtaaggtaagtagggttagggttaggtaaggttcggtacgttaacgg

SEQ ID NO: 146533 - DNA, 718 bp, Homo sapiens
  misc_feature: GYAE6OF02HEHC3.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggaccagagggaaccatggaaaccccagcgcagcttctcttcctcctgctactctggctcccaggctcagaaaccaccggagaaattgtgttgacgcagtctcaggcaccctgtcttgtctcgagggaancgccaccctctcctgcagcctccacgccagaactatccagacgtctaactacgatacgtccttacggtaccagacaaggaacgtcccgttagggcccgaagggtcccttaccccgtaagggttttccctacgaactttccgtacgttcggtccggttccggggtacccaacggtaccggggtaccctacgtccgggtacctaccgtaccccggaaggtacccgtagggttacccaagggttcggaacgtagggttcgggtaccgttaggggaccctaaagttacccgtttccgaacttcctacgaactttcgaacgtttacgacgtaacggtacgttgggaaccttacgaaggtaacttcgttacgacgtagttacgttacttacgtgtacgtacgtacgtaagtaccgtagggtaccttacgtacttcgtggttaccgttcggaaccgtacgggtaacgtacgggtaagaacgttagaaaccgtagttcggtagtacctaggaccctacgtgtacccgttag

SEQ ID NO: 146534 - DNA, 744 bp, Homo sapiens
  misc_feature: GYAE6OF02HDROG.21.4.A04.1.454.CMB.1.raw
  modified_base (197)..(197): a, c, t, g, unknown or other
  misc_feature (197)..(197): n is a, c, g, or t
  modified_base (333)..(333): a, c, t, g, unknown or other
  misc_feature (333)..(333): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccacggagaaattgtgtgacgcagtctccaggccacctgtcttgtctcgaggggaaancgccctacctctcctcgcacgcctaccgacgaccagaaacttacgcccaaggacaccttaactaaccagtacgcctacggtaccaaggccaaggaacgcccgtcgggaccaagggcccttacccgacggtttcccnctacttctatcgaccgtcggtacccagacgggtccaacgtcggaccacgtccgaacggtacgtacggttacgacggttcggcttacggggtacggggttacaggggtaaaccagtaacccgttccgaaccttcgtacgtattaccgtaattacggaccgtaacggtacgtcggaacgtcccgtaaggtaaacgttcgtttacggaaccgttagttacttaacgttcgtataccgaggtaacgtaggtaacgttcgtaacgtttacccgacgtttacgtggttacccggttaccggaaccgggttaacggaaccgttaaagggtaaacgttaaacgggtaccggaaaaacgttaaccgggttggttaccggtaacgttacggtaacccctacggttaccgttagttacccgg

SEQ ID NO: 146535 - DNA, 606 bp, Homo sapiens
  misc_feature: GYAE6OF02HQEQG.21.4.A04.1.454.CMB.1.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
tcagtcgtcgctcgcacgaccggtgctcgatttagagtagtgatcaggggagctctgagagcggagccccagccccagaattcccaggtattttcatttggtgatcagcactgaacacagaggactcaccatggagtttgggctgagctgggttttcctgttgttattttacaaggtgtccagtgtgaggtgcagctggtggagtcgtggggganacgttggtccagccgtgggacgggtccctgaacgcttctctggtcgcagcctngcattcaccttcagtcgaaccacaacagtggactcggggtccncgaggcctaccgagggagggctggagtgggcgacgtatacgaaggaacnctaacagttacagtacaagtacgacgcgagttctgtacggaaaggtggttccaacgtatcacgaaggaagtagtagacttaacgaaaacgtactacaacttagttaactctaagaactaaagacgtaacgacgtacctaaacggaaaaccgacggaaccgacccggtacgttaagtatttacggtggtaaggtaacgaaactaaaagggtcgaggtagtacggtaggtaggtacgtgtcgtaacgg

SEQ ID NO: 146536 - DNA, 787 bp, Homo sapiens
  misc_feature: GYAE6OF02IFJPW.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcacctgtctttgctcgagggaangccacctctcctgcagctccagccagaatataccagagtcctactaaccagtacgccttaggtaccaggcaaggaacgcccttagggacccctaagggcccttaccccgtaacgggttttcccctacgtaactttacccgttaagttccggtaccggtttccggggtacccccaacgggtaacgggggtccccaaccggttggggaccctaaccgttacccccgaaggtaacccgtagggtttccaacggttcggaccgtaggttcgggtacgtacggggactacgtaccgtttcgaccttctacgtaactactaagtttacgacgtaacggtaaccgttgggtaaccgtccgtaaggtaacgttacgtttacggcgttaaggttcgtttaacgtttacgtagtacgtaacggtcgtaaaggtacgtaagggttaacgttccgtaaccgtttcggttacgttaccgttaccggggaacctaaacggggtaaccgtaaacgggtaacggttaaaacggttaaccggtaaaccgttaacgttacgggttacggtaccgttacggtacccgtaaaccgttctaccggtttaacg

SEQ ID NO: 146537 - DNA, 597 bp, Homo sapiens
  misc_feature: GYAE6OF02JB8HM.21.4.A04.1.454.CMB.1.raw
  modified_base (217)..(217): a, c, t, g, unknown or other
  misc_feature (217)..(217): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctgggtggagtcgtgggggganacgttgggtccagcccgtgggacgggtccctggagacctctcctgtgcagcctctgctattcaccttcagtcaccacaacagtggacgttgggtcccgcaggctccgaaggggacgggctgggagtgggtcgcgtattacgaaggaagctaaacngttacagtacagatacgcgntctgtagaaggtaggtacacctatctacgaagagactagaattacaaaaggtactacacgtagttactctagaactaaatacgaaacacggacctaacggaaaacccgaggaaaccgaccgggtacgtagttacttagttacgggtagttaagaaacgtaaacggtggtaggagttaggttagggttggtaacgtcgttgtacgg

SEQ ID NO: 146538 - DNA, 630 bp, Homo sapiens
  misc_feature: GYAE6OF02FN21Q.21.4.A04.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
  modified_base (452)..(452): a, c, t, g, unknown or other
  misc_feature (452)..(452): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaattgtgttgacgcagtctccaggcaccctgtctttgtctccgaggggaaancgccaccctctcctgcagcctccagccagaatacnccagagctaactacatagcctaggtaccagcagaacnccgtggccaggcctacccgaggttccctacatcctagtcggccgtcgggacccctaggacgggccctacgtgggcctacctcccgaagacgtaggttcaggtcggcaggttcgggtcgtagggactacgtacttccacttctacatcatagctagcgtaggacgtacctaggtaacgtntttccgagtagttacgttaattcgtcgttcaagtaccgtaagtacgttacggtaacgttaccgtaccgttacgtggtttccggttaccgggtaaccggtaacgggaccgtaagggtaacggtaaagtaaccggtaacggtacgtaggtaggtccgtacggtactaccgattcgtaccg

SEQ ID NO: 146539 - DNA, 584 bp, Homo sapiens
  misc_feature: GYAE6OF02GYP57.21.4.A04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaattgtgttgacgcagtctccaggcacctgtctttgtctcagggaangccaccctntcctgcagctccagccagaatatccagacgcttaactacattacgccttggtaccagcaagaacgcctgggcctaggcctacccgaggtttccacacttcgtagtcgccttcggggtccccagacgggccacgtggccatcccgagactaggttcaggtcgacaggtggtctggacagtaccttnactcgtacatctagttcacgagtaactggagtcctagaagtntttacgagtagttntattacgtgtcagctagttcgtagacgttcaccgttcgtacggttccgttacggaccgtaacgggtactaagggttaaagtaacgtacggaaaccgttacgttaggtacgcgttacgaccgtaacctacttacgttacg

SEQ ID NO: 146540 - DNA, 652 bp, Homo sapiens
  misc_feature: GYAE6OF02G4WDP.21.4.A04.1.454.CMB.1.raw
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgttcctttgcctcgaggggaaancgccaccctgtcctgcagctccagccagaatacnccgaagcgtctaactacagtacgccgttaggtaccagaccagaacgccgtaggcccaagggcctacctagggtttcccacgatcctagtcgcccgggtcccaagcggtaccagttgaccgattcccgaagtactaggttcccgaaggtcggactacggttcggggtactcggggaacctaacgggtaccttttaccgaccttcgttaccaaacgttcgaagtttacgcgtacgtaacgtacgggacgtcctaagaacgtatttccgagtacgtggtattacgtgtacacggactagtaagttcgaacttcgaccttgttcgtcgttacgtcgaacggtacctaaggtaacgtaacgtagtaaaccggtaacgttcgtacgggtacttacggaccgtacctacgttacgtcttaccg

SEQ ID NO: 146541 - DNA, 680 bp, Homo sapiens
  misc_feature: GYAE6OF02GIJG6.21.4.A04.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanatccacctctcctgcagctccagccagaatanccagacgctacacatacgcctggtaccagcaagaacgcctcggccaggcctccccgtaggttccctcatcctatcggtcgtcgggtcccagcgggcctagtcggcacgtcccaggacacggttcaggttggcgtagggttcgggtctggggaactaggtaccttcgacttctactattaccgtaataggacaggtaccgtacggaagtccgtagtaacgttaacgtttccggacgtaggttcgtttaacgtttacgtcgttaacgaggtataacggtttagtaggggttaaccgtttaccgttacccgttacgttacggttaccgggtttaccgggaaccggtaacggggtaacccggtaaagggttaagtaaaacgggttacgaaaaccgggtaacgtttacgggtaggttacgtaccgaaccgttaccgacgtttacccgtttacg

SEQ ID NO: 146542 - DNA, 616 bp, Homo sapiens
  misc_feature: GYAE6OF02GZ4JY.21.4.A04.1.454.CMB.1.raw
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagacgttggtccaggcccgtgggacgggtcccctgagacctctcctgtgcagccctctgctattccacctttcagtcgaccacaacatggacgtggtcccgccacggcctacggagggaggggctgggaggtgggtcggccgtatacgaaaggaancgtaaacngtacagtacaagaagtacggcgtcgtacgtgtagaaagggtagtacccactactactacaaagngtaatntaacttacgaaagttaacctctaacgtgtatccgtagactaaaagctaaacgtacgtacgtaaccgaaaccggacggtaccgacggtaccgtagttacgttagtttacggtaggtaagaaacgtaaaggtggtaggtagttaggtggttaggtagtcgtagtacgg

SEQ ID NO: 146543 - DNA, 684 bp, Homo sapiens
  misc_feature: GYAE6OF02FI9K3.21.4.A04.1.454.CMB.1.raw
  modified_base (289)..(289): a, c, t, g, unknown or other
  misc_feature (289)..(289): n is a, c, g, or t
  modified_base (623)..(623): a, c, t, g, unknown or other
  misc_feature (623)..(623): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagttgggctgagctgggttttccttgttgttattttacaaggtgtccagtgtgaggtgcagctggtggagtctgggggagacttggtccagcctgggacgggtccctgagactctcctgtgcagcctctgcattcaccttcagtgaccacaacntggactgggtccgccaggcctccgaggggtaacggggctaggggagtggggtccggccgttaagttaaccgaaggaaacgctaaaccgaggtttaaccgaacgttaacgaacgaaagtaccgggcgtacggttactaggtagaaaagggacgtttccaaccgtagtcctacgaaaggagtaagttacgaattaccgaaaacggtaacctccctaaagttcgttaacgtactcggtaaccctaaagttaccgaaaacaccggtaacccgtaacggaaaaacccggacggaaccgtaccggtacccgttaggttacttacgttggtaacgggtaanaaccggtaaaaggttcgtagggtaacgttgggtagggttaggtagtacggttacgtaacgg

SEQ ID NO: 146544 - DNA, 594 bp, Homo sapiens
  misc_feature: GYAE6OF02IVHA7.21.4.A04.1.454.CMB.1.raw
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
  modified_base (413)..(413): a, c, t, g, unknown or other
  misc_feature (413)..(413): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagccgtggagggtcccctgagacctctcctgtgcagcctctgctattcaccttcagtnaccacaacatggactcgggtccgccgaggcctaccggaggggaagggctggaggtggtcgccgtatacgaagaagctaancgttaanagtacagaagtacggcngtctgagaaggaggtcacatactnaagtagatagaacttacaaacgtaactctactagttactctgaacctaaagtacgaacagacccgtaaaggaaaacccgtagggaacctaacgggaccgttagtactttaagttggtaaggtaagaaacgaaaggtcgtaggtaaggtgggttagggtacggtaggtaccgttggtaacgg

SEQ ID NO: 146545 - DNA, 757 bp, Homo sapiens
  misc_feature: GYAE6OF02I7A0V.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagctccagccagaatactccagagctactacatacgcctggtaccagcagaagcctggccaggcctcccaggttccctcactctatgcgtcgggcccacgacgggccacgtggcactcccgaagtactacggttcaggtcggaccgtaggtcgggtcgtacggggactacgtacctttcgaccttcgtactacttacctaaagtttacgactaacggacgttagggaaccgtccgtaagggtaacgttacgtttccggacgttaggtttaacgttaacgttttaaccgttcgggttacctaacggtaccgttaacgggttaacgtttaacggggtaaaccgttttcccgtaacccgttttacggtttccggtttaacccgggtttacccgggtaaccccggtaaaacggggtaacccggtaaaaggggtttaaacggtaaaaaccggttaacggggtaaaaacccggtaaccggtttaagggttaacgggttacccgttaccggaaccccgtaacccgttaacgttccggtttaaccgg

SEQ ID NO: 146546 - DNA, 562 bp, Homo sapiens
  misc_feature: GYAE6OF02ID2VA.21.4.A04.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtcgtcgctcgcacgaccggtgctcgattttagagtagtgatcaggggagagctgctcagttaggacccagagggaaccatggaaaccccagcgcagcttctcttcctcctgctactctggctcccaggctcagaaaccaccgganaaattgtgttgacgcagtctccaggcaccctgtctttgtctccgaggggaaancgcccaccctctcctgcagctccagccagaaatacgtccaagagctacacatacgcctaggtaccagcagaagcctaggccaggcctcccgaggttcctcgattctatcggccttcgggtccccacgacgggcccacgtcggccacgtcccgaagactacggttcaggtcggctaaggttcgggttctaggggaccaggtacctttcgaccttcgtacatctattacgcagactggactcgtagaagtacttcgntagtgttattacngtcagntagtagtggtatctacgttctgtccgtcgaccgaggacgtaaggtacgaatagaaccgtagtgtcgtcagaccactagtccttacg

SEQ ID NO: 146547 - DNA, 759 bp, Homo sapiens
  misc_feature: GYAE6OF02IOKPA.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaanacgccaccctctcctgcagctccagaccagaatactccagacgctactacatacgcctggtaccagcaaggaacgccgtcggacccgaggcccttaccccgtaggtttccctacacttccgttagtcggcgttcgggtccccacggacgggcccaacggttcggacctactacccgacggtaacgtacgggtttacaacgggttcgggaccgtaagggtttcggggtacgtacgggggtaaccctaacggttacccttttaccgaccctttccgttaccgtaacgttaccgttaacgttaacggtaccgtaacggtaacggtcgggtaaccggtaccgttacggtaaacggttacgtttacggacgttacggttagtttaacttttacgtagtaccgtagtacgtaggttaggtcggttaacgtcccgttacctacccgtaccgtacgttacgttaccgttaccggttttacgggacccggtaacggggtaaccggtaacgggtaacggtaaacgtaaccgtaaacggtacgttacggtaccggacgtacgacgtaccg

SEQ ID NO: 146548 - DNA, 650 bp, Homo sapiens
  misc_feature: GYAE6OF02HNPDZ.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctctgctactctggctcccaggctcagaaaccaccggagaaattgtgttgacgcagtctccaggcacctgtctttgtctcgaggggaaancgccaccctctcctgcagcctccagccagaaactactccaagacgtccttaactacatacgcctaggtaccagcagaacgcctggccaggcctcccgaggttcccacatctatcgcgtcgggtccccagacgggccacgtggaccactcccgagacgtacggttcgaggtcggacgtagggtcgggtcgtaggggactagtaccttcacttctactactacgtagtttagtacgtacgtggacgtccgttaagaagttacgtttcgacgttagttcgttaatttacgtcgtacgacgtacgtaaggttacttagggtaacgttaccgtaccgtttcgttcggttaccggttaccggaaccggtaacgggtaccgtaaagggttaacggaaagtaacggtaaacgtacgtacggtacggacgttacgaccgtaccgagttccgtagttaccg

SEQ ID NO: 146549 - DNA, 571 bp, Homo sapiens
  misc_feature: GYAE6OF02GDN42.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccacctctcctgcagctccagccagaactactccagacgctaactacatagcctggtaccagcagaagcctggccaggcctcccaggttcctcatctatcgctcgggtcccacgcgggccagtcggacactcccaagactaggttcaggtggactaggtgggtcgtgggacagtacttcactctcatcatagcagactggacgtcgtagaagtacttcgcgtagttagttattacgtgtcgaagtcgtagtagtaggtaacgttccgaccttcgtcggttccgttaccgggaccgtaacgggaacgtaaggtaacgaaagttacggaaaacgtacgtaggtcggtactacgtaccgacctagtctacgg

SEQ ID NO: 146550 - DNA, 832 bp, Homo sapiens
  misc_feature: GYAE6OF02F3L1Z.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacctgtctttgtctccgaggggaaancgcccaccctctcctgcacgcctccacgccaagtaactactccgagacgctactacatacgcctggtaccagcaagaacgccgtcggccacggcctaccctacggtttcctactatctagtcgtcgttcgggtcccacgcgggccctacgtcggacaaccgtcccgaaggaccgtacggtttaccaggggttggaccggtagggttcggggttcgtacgggggaactacgttaccttacggtaccttcctaccgaccctaacgtacccgtaccgtaaacgggtacgttacggggaaccgtaccgttaacggttaaacggtttacgtttttccggaacggttacgtttaacgggtttaacttttaacccgggttagttacccggtaagggttaacctttaagggtttaacggtttacgggttaaccgttacccgttaacccgttaacccgtttccccgtaaagtttccgttaacccggttttaccgtttttacccggggacccgggttaaaccgggggttaacccggttaaacgggggtttaacggtaaaacccgttaaccgggtaaaaaccggttaccggttaacggtttaccggggacgtttaacccggtacccgaaccccgtttaacgg

SEQ ID NO: 146551 - DNA, 803 bp, Homo sapiens
  misc_feature: GYAE6OF02HVX3O.21.4.A04.1.454.CMB.1.raw
  modified_base (609)..(609): a, c, t, g, unknown or other
  misc_feature (609)..(609): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggcacctgtctttgctccgaaggggaaatcgccctaacctctcctgccagcctccaagccaagtaaactactccgaagtacgtaccttaactaccaagttaacggccccgttacgggtaaccaacggaccgaaggtaaacggcccgtacgggaccccgtaacgggtcccccgttaccccgtaacggggttttcccctactaaactttaccgtaagttcgggcccgtttaccgggggtttaaccccaaacggacccgggggtaacccctacgggttccgggacctaaaccgttaccccgaaacggtaaccggttacgggtttaccgaacgggtttcggggaccctaaggggtttacggggttccgtagggggaaacctaacggttaccttacgtactcgtaactacgtactaagttagacgaacgtacgttacggacncgtaagtaacgttacgttcgacgttagtacgttaacgttacgttgtacgtaggacgttaagttacggtaggttaacttccgtaacttcgttggtaccgggttaccgtacggaacggaaccttaaagggtaacaaacgtaacggtaacgtaacgttggttaacgtccgtaacctaacgtacgttcgtaccgttac

SEQ ID NO: 146552 - DNA, 700 bp, Homo sapiens
  misc_feature: GYAE6OF02JEGLB.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcgttctcttcctcctgctactctggctcccaggctcacgaaaccaccggagaaattgtgttgacgcagtctccaggccaccctgtctttgctccgaaggggaancgacctacctctcctgacagctaccagccagtaatactccgagacgctaacgacgtatcgcctacggaccagcaaggacgcctaggacccaggtccctacccgtaggttccctacgtacgttcttacgtacgtccggtccgggtaaccccaacgaccgggaccctaacggttccgggacctaaccgttccccggaagtaccggtacggttaccgagggtcggaccgtagggttcgggtaacggtcgggaaacacggttccttaccgtcgttacctacgacttacgtacgtacgacgtacgtacggtaggacgtaccgttaaggaacgttattaccggaagtttacgttaacgttacgttacgttacgtacgagtacgttacgtacgttacggttaactccgtaactttcggtacgttacggtaacggactacgggtaataacgtaagaacgtaggaaacgtcgtggtacgtcgtacgacctaccgtagttccgttcg

SEQ ID NO: 146553 - DNA, 869 bp, Homo sapiens
  misc_feature: GYAE6OF02GD4V1.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaattgtgttgacgcagtctcaggcacctgtctttgctcgaggggaancgccaccctctcctgccagcctccagccaagtaactactaccaagacgtacctactacagtacgtcccttagggtaacccaggacaacggaaacgtcccgtagggaccctaacggggtcccttacccccggtaagggttttccccctacgtaaccgtttacccgttaacggtccggttaccccggttaccggggggtaccccccaaacgggtacccggggggtacccccttaaaccggttcggggtaacccctaaacccggttaccccccgaaaggggttaaacccggttaacggggttttaccgaacgggggtttcggggaaccgttacgggggtttccgggggttaaccggttacggggggaaaccttaaccgggttacccctttaaccgaaccgtttccctaaacgtacgttaccgttaaagttaccggaactaacgggttaaccggtacgggtaccgtaccggttaaggtaacgtttacggttaccggacgtttaaggttacgtttaacttaacgttcgtaccgagttacggtaagtttacggtacggttacttaccgtcttccggtttacggtacccggttacgaacgggtaccggaacgttaaggtaaacgtaagtaacggtaacgtaggttaggtacgacgtcggtaacctacgttagtccgttacg

SEQ ID NO: 146554 - DNA, 546 bp, Homo sapiens
  misc_feature: GYAE6OF02FNC00.21.4.A04.1.454.CMB.1.raw
  modified_base (199)..(199): a, c, t, g, unknown or other
  misc_feature (199)..(199): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctctcctgcagctccagccagaatatccagagctactacatagcctggtaccagcagagcctggccaggctcccaggttcctcatctagtcgctcgggtcccagacgggccactggccatcccagacgaggttcagtgctaggtcggtctgggacagtacttcactctcatcatagcacgactggacactgaagtnttcgctagtnttacttacgtgtacgtagactagttagtacgggtaagttaccacgttcgttggttcgttccgacggtaacgggacgtaagggtaagtaacgtacgaaacggtaacgttgtacggacgtacgctacctagtcttacg

SEQ ID NO: 146555 - DNA, 617 bp, Homo sapiens
  misc_feature: GYAE6OF02HHVPB.21.4.A04.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaancgccaccctctcctgcagctccagccagaactactccagacgctactacatacgcctaggtaccagcagaacgcctggccaggcctcccgaggttccncatctatcgccgttcgggtaccccacggacgggcccacgtcgggcctactccccgaagtacgtacggttcaggtcggcgtaggttcgggtctgggactagtacttcactctcatctatagcagacgtggactcgtagaagttcgttacgacgtagttattagttacgtgtacgagtactagttaacgtagggtaacttcctaccgttcgttcggttaccgttaccgggaccgtaacgggaaccgtaagggtaacgtaaacggtaacggaaaccgtacggttaggtaccggacgttacggaccaacctgttccgttacg

SEQ ID NO: 146556 - DNA, 584 bp, Homo sapiens
  misc_feature: GYAE6OF02FM13D.21.4.A04.1.454.CMB.1.raw
  modified_base (304)..(304): a, c, t, g, unknown or other
  misc_feature (304)..(304): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccagcctgggagggtccctgagactctcctgtgcagcctctgcattccaccttcagtgaccacaacatggactgggtccnccaggctccgagggagggctggagtgggtcggcgtatacgaaggaaagctaacngttanagtacaagatacgcgcgtntgtagaaagggtagttacaccactctacgaaagacgtagtagtattacgaaaacgtaacctactaacgttcgtaacttccgtagtaacaaagtacggaaacacgtaccgtacggaaaaccgacggaaaccgacgggtccgttagttattgttaggtagggtaataaggaaaagtgtaggtagtggtggtggtagtgtgtacg

SEQ ID NO: 146557 - DNA, 791 bp, Homo sapiens
  misc_feature: GYAE6OF02GC7BH.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaangccaccctctcctgcagcctccagccagaatactccagacgctactacatagcctggtaccagcaagaacgcctggcccaggcctccccgtaggtttccctactacgttcctacgttcggccgttacggggtccccaacgtcggggcctacgtcgggaccactcccgaagaccgtaggttacgaggtcgggcgtaggtcgggtcgtacggggactacggtaccttacgacttccgtactattccgtaacgttacgacgtaacgtaaccggtacgggtaacgtacccggtaaggtaaacggttacgttttaccggaacgttaaggtttacggtttaacgtttaccgttacgtttaccggtaacggttacgttaacgggtttaacggtttaacgggttaaccggttttaccgtaccccgttttaaccggtttaccgggttaaccgggtttacccgggtaaacccggttaaccgggggaaaccggttaaagggggttaaacggtaaaacggttaaacgggtaaaaccggtaacggtttacgggtacgggtaccggttacggtaaccctaaccggttacgttccggtttaaccgg

SEQ ID NO: 146558 - DNA, 696 bp, Homo sapiens
  misc_feature: GYAE6OF02HA65N.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcacctgtctttgctccgaggggaaancgccacctctctgcagcctccagccagaatactccgaggacgtctaactacatacgcctggtaaccagcgaagaacgccgtgggacccagggcctaccccgaggtttccactactctagtcgcgttacgggtcccacggtacgggccacgtcggactacgtcccgagaccgtaggttcaggtcggcgtagggttcgggtcgtaggggaacacggtacctttacgacctttccgtactaacgttacgtacgtttaacggaccgtaacgggtaacgttcgggaacggtccgtaagggtaacgttacgttttccggaacgttaacggtttacgttaacgtttacgtgtacgtacgtacgtaaggttacgtaggttaacgttccgttaccgttcgttcggttccggttaccggaccgaacggggtacgtaaagggttaacggaaacgttaacggaaacgtacgttacgggtaggtaccgtacgactaccgtacttcgtacg

SEQ ID NO: 146559 - DNA, 845 bp, Homo sapiens
  misc_feature: GYAE6OF02HOXOO.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgcctcgaggggaancgccaccctctcctgcagcctccagccaagaactactaccgaagacgaccttaactaccaataacgcccgttacgggtaccacgacaacggtaacgcccgttacgggacccgaacgggtcccttaccccgtaacgggtttccctactaacttcgttaacgttcgggacccggtttaccggggtacccccaacgggtaccggggtaccccaacggttccgggacctaaccgttaccccgaagtacccggttaaggtttccgaggggtacgggaccggtagggtttcggggttaccgtagggggaacctaacggtacccttttaccgaaccgtttccgttaacgtaacgtttaccgttaaacgtttcggaaccgtaaacgggttaccggttaggggaaccgttacccggttaaggtaaacgtttacgtttaccgggacgtttaagtttacggtttaacttacgtacgtacgtaacggtaccttaagggtacgttaacgggttaaccttaccgtaccttacgggttccgttaccgggttaacccgggtaccgggtaaccgggaaccgttaaaagggtaacggtaaacgtaacgggtaaacgtaaggttcggttacgacctaggtaacccaacgttacgtacggttacg

SEQ ID NO: 146560 - DNA, 595 bp, Homo sapiens
  misc_feature: GYAE6OF02HUOC0.21.4.A04.1.454.CMB.1.raw
  modified_base (216)..(216): a, c, t, g, unknown or other
  misc_feature (216)..(216): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccagcctggagggtccctgagactctcctgtgcagcctctgcattccacctttcagtcgaccaacaacatggactgggtccgccaggcctccgaggggacggggctgggagtgggtcggaccgtattacgaaaggaagctaacagttacagtacagaataccggcgcgtctagtagaaagggagttccaacgtatacgtacaaagagatgaacttacaaaagtactacgacttgtaatcgtagactaaagtgaacngacctaagaaaaccgnggaaccaaccgggtcgtagttactttagttagggaggttaaacgaaacgtaaaaggtggtaggtagttacgggttgggtagggtacgtcgttaggtaccg

SEQ ID NO: 146561 - DNA, 719 bp, Homo sapiens
  misc_feature: GYAE6OF02HUV5V.21.4.A04.1.454.CMB.1.raw
  modified_base (199)..(199): a, c, t, g, unknown or other
  misc_feature (199)..(199): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgctccgaggggaancgccacctctcctgcagctccagccaagaatatccagacgctactacatagcctaggtacagcagaacgccgtaggccaggcctcccgtacggttcctcattcctagtcgccgttcggtaccccacgacggaccagtcggacactacccgagactaggttccagggtcgatacgggtcgggtcgaggacagtacttcactcnctatctacgtagcgtagacgttggacgtaccgtagtaaacggttgtttccggacgttagttacgttaacgtttaccgttaggtaccgtaacggttaccgtaaaggtttacgttaacggggttaaacgttttaccccgtaaccgtttaccgggtttcggttaacccgggtttaccgggaaccccggttaaaccgggggttaaacccggtttaagggtaaaacggtttaaaaccgggaacggtaaaacccggttaacggtttaccgggtaacgggtaccgttaaccggacccgttaacccgttacgttcctttaaccggg

SEQ ID NO: 146562 - DNA, 798 bp, Homo sapiens
  misc_feature: GYAE6OF02GMWJZ.21.4.A04.1.454.CMB.1.raw
tcagtcgtcgctcgcacgaccggtgctcgatttagagtagtgatcaggggagctctgagagcggagcccccagcccccagaattcccaggtgttttctatttggtgatcagcactgaacacagaggactcaccatggagtttgggctgagcgtgggttttccttgttgttattttacaaggtgtccagtgtgaggtgcagctggtggagtcgtgggggagacgttgggtccaggccgtgggacgggtccctgagacctctcctgtcgcacgcctctgctattcctaccttcagtcgaacccaacaactagtcggaccgttcgggtcccgacccgaggtcccgtaccggaaggggaacggggcgtagggacgggttcggggtaccggaccgttaagttaaaccgaaagggtaaaacgtaccgtaaaaccgtaaggtttaaccgaaagtaaaccgaaaggaaacggtaacgggccgtaccggttactagggtaagggaaaacgggtaacggtttaccaaccgtaagtacccgtaacgaaagtaagtaagtagtaaacttaacgaaaacgtaacctactaacgttacgttaactacgtacgaaacgtaaaagtaccggaaaccgtaacggttaacccgtaaacgggaaaaacccgggaacggaaacccggttaaccggggaacccgtttaggttttaacgtttacggtttagggtaacgggtaaaacgtaaacggtaaaaaggtacggggttaggtaacggttgggtttaaggggtacggtacggtacgttcgggtaacgg

SEQ ID NO: 146563 - DNA, 748 bp, Homo sapiens
  misc_feature: GYAE6OF02JZ7EF.21.4.A04.1.454.CMB.1.raw
  modified_base (239)..(239): a, c, t, g, unknown or other
  misc_feature (239)..(239): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagtcgtcgctcgcacgaccggtgctcgatttagagtagtgatcagggaggagctgctcagttaggacccagagggaaccatggaaaccccagcgcagcttctcttcctcctgctactctggctcccaggctcagaaccaccggagaaattgtgttgacgcagtctccaggcaccctgtcttgtctccgagggaaagacgcctaccctctcctgcacgcctccgacgccagaattacnccgaagacgtactactacatacgcctaggtaccagcaagacgccgtgcccgacgccttaccccgaggttccctcactcgtatcgccgtcgggtccccaacggccgggccctacgtcggccaccgtccagtacgtcggtcaggtcgcgngggttcggtcggnggtaacgacgtacgttccctaactccgtcctactactagttacggaacctcggtagtacgggtaccgtaccggttaggaacgttacgttaaccggtcgtaaacggtttcgttaaaccgtttaccggtcgtaccgttaaagtaccggttaaagttaccggggttaaacgggtttaacccgttccctaccgggttttagtaccccggttttagggtacccgttaaaacccgggacgggttaaacccgttaaaggggtaaacgttaaaccgtaaagggggtaaaaccctaaccgggttttggggtaaccgtacgggttaccaaccgggaaccttttagttacccggttacc

SEQ ID NO: 146564 - DNA, 823 bp, Homo sapiens
  misc_feature: GYAE6OF02JM6R3.21.4.A04.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggtttctgtgtatttacaggtgtcagtgtgaggtgcagcgtggtggagtcgtggggganacttggtcccaggccgtgggacgggtccccgttgacggaccttccgtccgtgtggactacgccgttctgacactttccaaccctttgacggttcaaccccacaaaacctaggtcgggtaccgttcgggggttccccgaccgagggtccctacccgggtaagggggacgggggtaccgtggggtacgggttcgggggtcccgggcccggtttaagttaaaccggaaaagggtaaacggccgtttaaaacggacgttttaaacgaacggttaaaccgaagggtaaacgttaaccggggtcccgaaccggtttcccgtaagggttaaacggggtaaaacggggtaacgggtttaaacccgaccgttaaacggttaccctaagtaacgggtaaagtagttacgggtaaactttaaccgaaaacggtaaactacccgttaagttacggttacttaaccgttgaaaccctaagtaacgaaacgacgtaaccgaacggtaaaaccgaccgggttaaccgaccggtacgtttaactaggttttaccgtagggtacggtaataaaccgtaaagggttacgtagtaacgttgggtaaggggttacgtaggtccttaggtaaccg

SEQ ID NO: 146565 - DNA, 719 bp, Homo sapiens
  misc_feature: GYAE6OF02IMU5P.21.4.A04.1.454.CMB.1.raw
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagcttgggtttccttgttgttattttacaaggtgtccagtgtgaggtgcagctggtggagtcgtggggggagacgttggtccagccgtggacgggtccctgacgactctcctgtgcagcctctgctattccaccttcagtcgaacccaacaaaccagtgggtaccgtcgggggtcccgcccacgggcctaccggaagggggaacggggctaggggagggttcggggtccggaccgttaagttaaaccgaaagggtaaaacgacctaaaacgtacgttaacaagtaacgaagtaaacgtacgggcgtacggttcgtaggtaaggaaacgggtaacggttccaacctaattccgtaacgaaagtaacgagtagtaaacttacgaaaacgttactacaaccgttagttaactcgtagaaactaaactacggaaacacggtaacctaaacggaaaaacccgggagaaccggaaaccggttccgttaagttacgtttagttagggtaacggttaaacgaaaccgtaaaaggtcggttaaggtagttcgggttgggtaggtacggtcgttaggtaaccg

SEQ ID NO: 146566 - DNA, 702 bp, Homo sapiens
  misc_feature: GYAE6OF02GY9C5.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagcccaccctctcctgcagcctaccagccaagaatactccagacgctaactacatacgcctaggtaccagcaaggaacgccgtggcccaggtcctcccgaggttcccactattctagtcggtcgtccgggtacccacggacgggccctacgtggaccactacccgagacgtaggttcaggtcggcgtagggtcgggtcgtacgggactaacgtaccttcgtaccttcgtactacttacgtaagttacgactacggtacgtaggacgtccgttaggtaaacgttcttaccggacgtacggttagtttaccttacggtacgtcgtaacggtacttaaggttagtaacgggttaaccgtttacccgtaaccgtttccgtttcggttaccgggttaccgggaccggtaacgggtaaccggttaaagggtaacggtaaacgttaaacgggaaaccgttaaccgtagggttaccggtcgtaccggtaaccaccgttagttccgtacg

SEQ ID NO: 146567 - DNA, 756 bp, Homo sapiens
  misc_feature: GYAE6OF02I40XX.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcctttgtctccaggggaagngccaccctctcctgcagctccagcccagtaactatccaagacgctactacatacgcctggtaccagcagaacgcctgggcccaggcctccccgaggtttccctacgattcgttaatcggccgtcggggtaccccaaccgacggggtaccccacgtaccggacaaccttccccgaaggaccgtaggtttaccaagggttcggaccgtaagggttcggggttacgtacggggtaacaacgtaaccgtttccgtaccttacgtactagttacctaaagtttacgacctaaggacgtacgggactacccgttaggaacggtacgttttaccgacgtaggttacgttaatttaaccgtggttacgtacggtacgtaacggttaagtaacgggtaagtttaccgtaacccgttacgtttaccggttaccgggtttaccgggtaacccgtaacgggggtaaacccgtaaagggttaaacggtaaaacgtaacggtaaaaccggttaacggtacgggttacggtacgttaacggacccgtaacccgtacgttaccggttaccg

SEQ ID NO: 146568 - DNA, 629 bp, Homo sapiens
  misc_feature: GYAE6OF02GLI5X.21.4.A04.1.454.CMB.1.raw
  modified_base (200)..(200): a, c, t, g, unknown or other
  misc_feature (200)..(200): n is a, c, g, or t
  modified_base (621)..(621): a, c, t, g, unknown or other
  misc_feature (621)..(621): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaagngccacctctcctgcagctccagccagaatactccagagctactacatagcctggtaccagcagaacgcctggccaggcctcccgaggttcctacgattctagtcgcgtcgggtacccaggacggcctagtcggcacgtcccgagaccgtaggttacaggtcgacgtagggtcgggtcgtacgggactagtacctttccgaaccgttcctacgacgttctaacgtttacgacgtacgtacgtacggacgtaccgtaaggtaacgttacgtttcgacttaggttgttacttacgtgtacgtagtacgtaggttacgtacggtaacgttccaccgttcgttcggttacgtcggaccgtaacgggtacctaaggtaacggtaagtacggaaacgttacgtggtacgacgtaccggtacaccgttntcgttacg

SEQ ID NO: 146569 - DNA, 717 bp, Homo sapiens
  misc_feature: GYAE6OF02I2GLK.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtcctttgtctccaggggaaanacgccaccctctcctgcagctccagcccaagaactagtccagacgtcctaactacattagcctaggtaccagcaagaacgcctggcccaggcctccccgaggtttcccactactctagtcggccgttcggggtaccccacgaacggggtcccaacggttcgggacccacgtccccgaagtaccgtaggtttaccgaggtcggaccgtagggttcgggtcttaggggaacctagtaccgttccgaacgttcctcgagtctaagttacgctaacgtacgtggacgtcctaggtaacgtacgtttcgacgttaggttacgttaacgtttacgtcggtacaagggtactaaggttaacggtttacggtaacgtttcccgtaacgtttccgttaggttcccggttaacggaacccggtaacgggtaaccgtaagggttaaacggtaaacggttaacggaaaaccgttaacgttacggttacggaccgtttaccggaaccttaccgtacgttccgttaccgg

SEQ ID NO: 146570 - DNA, 578 bp, Homo sapiens
  misc_feature: GYAE6OF02JA8ON.21.4.A04.1.454.CMB.1.raw
  modified_base (281)..(281): a, c, t, g, unknown or other
  misc_feature (281)..(281): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttgggtccagccctgggacgggtccctggagactctcctgtgcagcctctgcattcaccttnagtgaccacaacatggactggggtccgccaggcctccgaggggaaggggctgggaggtggggtcggtccgtattacgaaggtaaagctaaacagttaacagtaacagaatacgggcncgtctgtagaaagggtagttccacctatctnaaagagatagattacaaaagtactacactgtactcagacaaatgaacagacctaacggaaaccgaggacaccggccgttagttacgtagttggtaggtacgaaacgtaaagaggtaggaagttggtagggtaggtacgtcgtaggtacg

SEQ ID NO: 146571 - DNA, 606 bp, Homo sapiens
  misc_feature: GYAE6OF02HD509.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagctccagccagaatatccagacgctactacatacgcctggtaccagcagaagcctggccaggctcccgaggttccctcatctatcgccgtgggtccccacgtacgggcccacgtcggccacgtcccagaccgtaggttcaggtcggcgtaggtcgggtcgtggggacacgtaccttcacttctctatctattagtagacgtggactcgtagaagtacttcgacgtagttcgttacgttcgtcgtacaggtactaggttagttggtaaactttccgtaccttgttccggttacgttaccggaccgtaagggaccgtaagggttaacgaaaggttacgaaaacggtacgttaggtacggacgtacggaccaccgtacttccgttgtacccg

SEQ ID NO: 146572 - DNA, 768 bp, Homo sapiens
  misc_feature: GYAE6OF02FWKRH.21.4.A04.1.454.CMB.1.raw
  modified_base (197)..(197): a, c, t, g, unknown or other
  misc_feature (197)..(197): n is a, c, g, or t
  modified_base (345)..(345): a, c, t, g, unknown or other
  misc_feature (345)..(345): n is a, c, g, or t
  modified_base (616)..(616): a, c, t, g, unknown or other
  misc_feature (616)..(616): n is a, c, g, or t
  modified_base (738)..(738): a, c, t, g, unknown or other
  misc_feature (738)..(738): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcacctgtctttgtctcgagggaanactccacctctctcgcacgcctcgacgccaagtaactactccaagtacgtactaacctaacgatacggtcccttagggaccctaaggaccgaacggaaacgtccgtacggacccgtacggtccctaccccgtacgggtttccccttanacgtttaccgtagtccgggtccggttaccggggtccccaacggacggggtacccctacggtacgacctaccgtacccgaaggtaaccgtagggttacgacgggtagggtcgtaggggttcggttaccgggtagggaaacctacggtacccgtttaccgaaccgttccgtacctaagtccgttaaaacgttcgaacgttacggtacgtacgggaaccgttacgtaagggtaaaccttccggtttacgacgtaggtttacgtaacgtttacgngtacaggtacgtaagttcggtaacggtcttccgtacgtttcgtacggttccggtacggacgaaccgggttaacgaaggtaacgtaacgtaaacggtaaaccggtagttacggtacggtaacnccggtaaccgtacgtacgttacgttaccgg

SEQ ID NO: 146573 - DNA, 782 bp, Homo sapiens
  misc_feature: GYAE6OF02FJHU3.21.4.A04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctntcctgcagctccagccaagatactccagacgctaactacatagcctaggtaccagcaaggaacgcctggaccagggcctaccccgtaggtttccctcgaattcgtaatcgccgttcggggtaccccaagacggggcccaacgtcgggccaactccccgaaggaaccgtaggttccagggttgggacctaggttggggtctaggggaacctaacggtacctttcgaaaccttctactacgttacgtaacgtttacggacgtaacggtaaccgttacgggaacgtacccgttaagggtaaacggttacgttttaccgggaacgttacggtttacggtttaaagtttaaccgttcggttaaccgttaacggtaaccgttaaggtttaacggttaacggggttaaaacgttttcccgaacccgttttcggtttacggttacccggtttaccggaacccgggtaaacggggtaacccggttaaaaggggttaaacggtaaaacgttaaacggaaaacggttaacgttacgggtaccggtacgttaccgaaccgtaaccgtacgttaccgttaaccgg

SEQ ID NO: 146574 - DNA, 669 bp, Homo sapiens
  misc_feature: GYAE6OF02F4UA3.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaangcccaccctctcctgcagctccagccagaatatccagagctactacatacgcctaggtaccagcaaggaacgccgtaggcccaggcctccccgtaggtttccctacacgttctagtcggccgttcgggtccccaaggcgggtccctacgtcggccactcccgaagaccgtaggttcaagggttcggcgtagggttcgggtacgtaggggaacctaggtacctttcacgttccgtactattcgtaacgttacgacgtacggtacgtcggacgtaccgtagaacggttacgtttcgacgtagttagttacttacgtagtcgtagtcgtaaggttacgtagggtaactttcctaccgttcgttcggttaccgggttaccgtaccgtaacgggtaaccgtaagggttaaacgaaacgttaacggaaaccgttaagtcggtacggacgtcgtaccgtaccgtagttacgttacg

SEQ ID NO: 146575 - DNA, 539 bp, Homo sapiens
  misc_feature: GYAE6OF02GBJQ6.21.4.A04.1.454.CMB.1.raw
  modified_base (493)..(493): a, c, t, g, unknown or other
  misc_feature (493)..(493): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagcccaccctctcctgcagctccagccagaactatccagacgctactacatacgcctggtaccagcagaacgcctggccaggcctcccgaggttccacatctatcgctcgggtacccagacgggccacgtggcactcccagactaggtcaggtcggcagggttcgggtctgggacagtacttacacgtctcactctattagcagacgtggactcgtagaagtacttcgactagtcgtattctgtcagctagtagtgtaatctactgtcgtcgtcgacgacggactaaggtanaagtacggaaacgtacgtaggtacggctacgacacgtacgtgtacg

SEQ ID NO: 146576 - DNA, 661 bp, Homo sapiens
  misc_feature: GYAE6OF02H5P6N.21.4.A04.1.454.CMB.1.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagaaaccaccggagagattgtgttgacgcagtctccaggcacctgtctttgtctccgaggggacagacgcccacctctccgtggccggggccagtcaaattcgttacccgngtactacttacgcctggtaccngcaacgaaacctggccaggcctccagacctctcatccacaatatatctacgacgggccgcgggcactcccagactaggttcaggtcggcgtaggtgggtcgtaggacgagtaccgttcacttctccaaccattacgacgtacgaacgacgtacgggacgtaccgtaggtaagttagtttttacgactaaagttagttaactttaacgttcgtaacgtaacgtactaaattacgtcgtaccctacccgacccccgtattacccgtacccgtttccggaacccgtaaacgggaccctaaccgtacgtacgaacgtacgtaacgtaacgaaaccgtacgtcggtacggtcgtacgtacccaccgtacttcgttccgttccttacttaccttcccgttaccccg

SEQ ID NO: 146577 - DNA, 596 bp, Homo sapiens
  misc_feature: GYAE6OF02FSWML.21.4.A04.1.454.CMB.1.raw
  modified_base (200)..(200): a, c, t, g, unknown or other
  misc_feature (200)..(200): n is a, c, g, or t
  modified_base (247)..(247): a, c, t, g, unknown or other
  misc_feature (247)..(247): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccaccctctcctgcagcctccagccagaatatccagagctactanatagcctggtaccagcagaagcctggccaggctcccaggttcctcatctatgctgggtcccacacgggccactggcatcccagacaggttcagtggcaggtgggtctgggacagacttcactctcatctatagcagactggagcctagaagtatttcgactagttgtactttacgtgtactagcgtagttacgtaggtaacgtttctacccgttcttacggttccggtttaccgggacccgtaacggggtaacccgaaagggttaacggtaaaactacgggtaaaaccggtaacgtttagggttacgggtaccgttaggtaacccgacccgttagtacccgtttaccgg

SEQ ID NO: 146578 - DNA, 795 bp, Homo sapiens
  misc_feature: GYAE6OF02IG9O1.21.4.A04.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (321)..(321): a, c, t, g, unknown or other
  misc_feature (321)..(321): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccacggagaaattgtgttgacgcagtctccaggcctacccgtgtctttgtcctaccgaaggggaaancgtcccaccctntcctgccagtcctccagccaagtaatactccaagactctaactacatacgccttaggaccagcgaagaacgccgtggaccacggcctcccgaaggttcccanaactctaacgtcgtccgtcgggacccccaggacgggcccaagttgggaccaaacttcccgaaggtaaccgtaggttacccgaaggtcgggacctaaggggtttcggggtacccttagggggtaaaccaagggtacccttttacgaaccgttcccgttaactaacgttactaaagttaaccggacgtaacggtaagtacgggtactaccggttaagtaacgttacgttacggaacgttaaggtttacgttaaacttacgtggtaaccgtaacgtaacgtaaaggttagggtaacgggttaaaaccttaccctaaccggttttcgttacgggttaacccggggtaaccggaaacccggttaaacggggttaaaccgtaaaagggtaaaacgtaaaacggtttaaccggaaaaacccggttaacgttcgggttaacgtaccggaaccttaaccggtaaccttacgttcggtttaacg

SEQ ID NO: 146579 - DNA, 804 bp, Homo sapiens
  misc_feature: GYAE6OF02G5KDX.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaacacgccaccctctcctgcagctccagccagaatatccagagctactacatacgcctggtaccagcagaacgtcctggccaggcctcccgaggttcctcatctatcgcgtcgggtacccagacgggcctacgtcggcactcccgaagtacgtacggtttcaggttcggactacgggtttcgggtccgttaggggaacctaagggttaccctttaccgaaaccgtttccgtaacgtaacgtttaccgtaaacgttttacgggaccgtaaacggtaccggtttaggggaaccggttacccgttaagggtaaaaccggtttaccgtttttaccgggaaccgtttaagggttttaccggttaaacgtttttaacccgttcgggttaacctaacgggtaaccgttaacgggtttaaacggttaaccggggtttaaacggtttacccgttaacccgttttacggttacggtttacccgggttacccgggtaaacccgggtaacggggttaacccgtaaacgggttaacgaaaacggttaccgggtaaaaccgtaacggttacggtacgggtaccgttaccggtaaccctaaccggttacgttccgtttaccgg

SEQ ID NO: 146580 - DNA, 759 bp, Homo sapiens
  misc_feature: GYAE6OF02GSMJK.21.4.A04.1.454.CMB.1.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacttggtccagccgtgggacgggtccctgagactctcctgtncagcctctgcattccaccttcgagtgacccacaaacagtcggactggggtcccgccgacggctccggaaggggacggggctgggagggttcgggtcgggtaccgttaagttaccgaaaagggtaacgacttaaacgtaagttaaccgaagttaacgaaggaaagtaaccgggccggtacggttaccgtagggtaaggtaaaaaggggtaacggtttacccaaaccgtacgttaccgtaacgaaagaacggtaagttagaacgtttaaaccgaaaaggttaaacctccgtaaacgtttagaacgtttccgtaacgaacttaaaacgtacggaaaccctacgtaacccgtaaacgggaaaaaaccccggtaagggaaccctaaccggggtaccgttacgtttacgtttaaggttacgggttaaggtaaacggtaaacgaaaaacggtaaggttacggtaaaggttgggtttaacgggtagggtaagtaccgttggtaaccgg

SEQ ID NO: 146581 - DNA, 777 bp, Homo sapiens
  misc_feature: GYAE6OF02GEMJL.21.4.A04.1.454.CMB.1.raw
  modified_base (538)..(538): a, c, t, g, unknown or other
  misc_feature (538)..(538): n is a, c, g, or t
tcagtcgtcgctcgcacgaccggtgctcgatttagagtagtgatcgaggggagagctgctcacgttaggacccagagggaaccatcggaaaccccagcgcagcttctcttcctcctgctactctcggctcccaggctcagaaccacggagaattgtgttgacgcagtctccaggcaccctgtctttcgtcgtccgaggggaaacacgccaccctctcctaggccaggcctccaggcctaagtaactacgtccgagtacgtactacctacaactacggtcctaggtaacccaggaccaacggaaaccgcccgttacgggaccctaacgggtacttccccgtaacggtttcccctagtacttaccgtaatcggtccgtaacgggtcccctaaggacgggtccaaccgttcgggaccacgttaccccgaaggtaccgtacggtttacaacgggtcggtccggtaaggtttcggggtaccttaggggaacctacggtaccttcacgttccacgaactcacgttacgactacggacgtacggngtaccgtaggtaacgtacgttacgtacgtagtttagaccgtttagtcgtaacctaggtccgtaagttcgtaacgggttaccttacctccgtttaaccgttcggttacccggttaacgggtacccgtaaggggtacccgtaaaagggtaacggtaaaccggttaacggtaaaaccggtaccggttaggttaaccggggtcctttaacggacccgtaaccgttaggtttcccgtttaaccg

SEQ ID NO: 146582 - DNA, 710 bp, Homo sapiens
  misc_feature: GYAE6OF02HXAKX.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttcttgttgttattttacaaggtgtccagtgtgaggtgcagctggtggagtcgtggggganacttggtccagcctgggacgggtccctgagactcgtcctggtgcagcctcgtgctacttcacctttcgacgtcgaaccacgtaaactacgtacggaaccgtggggtaccacggcccgaaggtccgtaccggaagggggaacggggcgttagggagggttcgggggtaccggtaccggttaagtttaaaccggaagggtaaaagaccttaaaacgtaacggtttaaaccaggtaaccgaaagtaaacgtaccgggcggtaccgtgtaggtaaggaaaaggtaacggttaccaaccgtaagtacctagtaaacggagtactaacgtaacttaacgaaaaggtaacctaacgtaactagtaactcgtaagtaactaaagtacgaaactacgaccgtaagaaaaccgacggaacgaccggtacgttagtactttaggtgttacggtaagaaacgtaaaagaggttacggtagtaggttgggtaacgtaggtagtacgg

SEQ ID NO: 146583 - DNA, 282 bp, Homo sapiens
  misc_feature: GYAE6OF02GLIPK.21.4.A04.1.454.CMB.1.raw
  modified_base (201)..(201): a, c, t, g, unknown or other
  misc_feature (201)..(201): n is a, c, g, or t
  modified_base (272)..(282): a, c, t, g, unknown or other
  misc_feature (272)..(282): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanagccaaccctctccgtgcagcctccagccagaatatccagagctactacatagcctggaccagcagaacgnnnnnnnnnnn

SEQ ID NO: 146584 - DNA, 779 bp, Homo sapiens
  misc_feature: GYAE6OF02H13XH.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagaaattgtagttgacgcagtctccaggcaccctgtctttgtctccgaaggggaaancgccaccctctcctgcacgcctccagccaagaatactccagatcctactacatacgcctacggtaccagcaagaacgtcccgtgggaccacgggcccttaccccggtaagggttttcccctactaacgtttccgttaacgttcggtccggtttaccggggtacccccaaacgggtaaccgggggcccctaaacgggtcgggtaccctaccgttacccccggaaaggtaccggttaacgggtttcgaaacggggtttccgggagttaacgggggttcggggttaaccggtacgggggaaacctaacgggttacctttaccggaaccttcgttaaccgactccgtaagttacgagtaccccgagtacggacgtactaggtaacgtacgtttcggacgttagttagttacttaactcggtagtacgtacgtaagttacggtacggttaattcccgttaaccgttcgttacggttccgggttaccggtaccgtaacgggtaaccgtaaggtaaacgaacgttaacggtaaacgtaaccgtaggtacgcgtaacgtacctaacgttacgtacgttaccgg

SEQ ID NO: 146585 - DNA, 728 bp, Homo sapiens
  misc_feature: GYAE6OF02GCA22.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngcccaccctctcctgcagctccagccagaatactccagacgctaactacatacgcctggtaccagacagaacgcctggcccaggcctcccgaggttccctacgtatctatcgccgtcgggtacccacgacgggccacgtcggacctactcccagaccgtacggttcgaggtcggacgtaggtcgggtcgtagggaactacggtaccttccgacttcctacgtacttaccgtaagttacggacgtaaggtaccgtacgggtaaccggtacccgttaaggtaaacggttacgtttacggacgttaagggttacgtttaacgtttaacgttacggttaccaacggttacgttaaggttacggttacggttaaccggtcccttaacccgttaccccgtacccgttaacgtttaccgttaacctttaccggttttacggaacccgggtaacggggtaacccgtaaggggtaaccgtaaacggttaaccgaaaccggttacgtacggtacgtaccgtacggacccgtaaccg

SEQ ID NO: 146586 - DNA, 716 bp, Homo sapiens
  misc_feature: GYAE6OF02GAFNT.21.4.A04.1.454.CMB.1.raw
  modified_base (203)..(203): a, c, t, g, unknown or other
  misc_feature (203)..(203): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagtcgtcgctcgcacgaccggtgctcgatttagagtagtgatcaggggagagctgctcagttaggacccaggagggaaccatggaaaccccagcgcagcttctcttcctcctgtctactctggctcccaggctcagaaaccaccggagaaattgtgttgacgcagtctccaggcaccctgtctttgtctccgaggggaaancgcccacccgtctccgtggccagcctccagccagaatactccagagtctactacatacgcctaggtaaccagcaagaacgtccgtcggaccgacggcctaccccgtaagggtttaccctacgtaacttccgtaacgtcgtaccgttaccgggtaccccaagtaccggggccctacgtggccaacgtacccaggtacctacggttacgaggttcggacgtagggtcggtacggtgggactaggtccttcacgttcgtacactactagtacgntaacgtnggacgtcgtaggaacgttacgttcgacttaggttactttaacgttacgttcgtaccgtaacgtacgttaaacgttcggttaacggttaaccgttcccgtaaaccgtttccgttacgggttccgggtaaccggaaccggtaaacggggtaaccgtaaacgggtaaggtaaaaccgtaagggaaaaccgtacggttgtacgggtaccgttacgaccgtaacccgtgttacttaccgg

SEQ ID NO: 146587 - DNA, 740 bp, Homo sapiens
  misc_feature: GYAE6OF02G6VFA.21.4.A04.1.454.CMB.1.raw
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccaggcaccctgtctttgtctccgaaggggaaagacgcccaccctctcctgcacgctccagccagaatactccaagagcctaactacatacgcctggtaccagcaaggaacnccgtggaccgacggcctccccgaaggtttcccncacttctacgtcgcgtaccgggtcccaacgcggggtacccacgtggtacctacgtacccgaagaccgacggtttccgaaggtcggccgtagggttcgggtcctaggggactaacggttaccgttaccgtacctacgttacacgtttacgtaacgtttacgacgtacggacggtaggacgtccgttaaggtaacgttacgtttaccgacgttagttacgttaactttccgtagtaccgacgttagtacggttaagttacgggtaaacgttccgttacccgttaggttcccggtttaaccgggttcccgggaaccggtaaaccggggtaacgtaaacggggttaaacgtaaaacggttaacggaaaacccggttaacggttacggtacggttacgtaccggaacccgtacgtaccgttacgttaccgg

SEQ ID NO: 146588 - DNA, 761 bp, Homo sapiens
  misc_feature: GYAE6OF02GYUDT.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccgaggggaaangccacctctcctgcagctccagccaagaactactccaagacgtctaactacagtacgccgtaggtaaccagacaaggaacgccgtagggcccaacggtcccttaccccgtaagggtttccctacgtaacgttaccttaagtcggtccgttaccggggtaccccaacggacggggtaccctaccggtacgggacctaaccgttccccgaaggtaaccgtacggtttacgaacgggtttcgggacgtaaggggttcgggttaccgtagggggaactaacgggtacctttaccgaccttccgtacgtacgttacgtaacgtttaccgacgtaacggtaccgtagggaccgtcgttaaggaacgttacgttacggacgttaggttacgttaactttacgtagtaccgaagtacgtaagttacgtacgggttaaacttccgtaaccgttcgttacggttaccgttcggaccggtaacgggaccgttaaagggtaacgtaaacgtaacggtaaaccgtacggttacggacgggtacctacggtaaccgtaccttacgttaccttacgg

SEQ ID NO: 146589 - DNA, 730 bp, Homo sapiens
  misc_feature: GYAE6OF02GVNIC.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctcgaggggaaancgccacccttctcctgccagcctaccgagccaagtaactactcccgaagacgtctaactacacttacggccttgggtaacccagtaccaaggtaacgccgtagggaccctagggtcccttaccccgtagggtttccctacgaacttccgtagttcggccgttaccggggtaccccaacgggtacggggcccctaacggttcgggaacctacgtaccccgaagaaccgttagggttaccaagggtttcggaccgtacgggttcggggtccgtacggggtaaacacggttaccttaccgacccttacgtactagtacgtaactttacgacgtacggtacgtaggacgtacgtaggaacgttacgtttacgacgtaggttagttacgttacgtgtaccgtaggtactaggttacgtacggtaacgttcctacgttacgtcggttacgttccgggaaccgtaacgggtacgtaaaggttacgaaacgttacgaaacgttagtcggtacgtacacgtaccgacttacgtcgttacg

SEQ ID NO: 146590 - DNA, 795 bp, Homo sapiens
  misc_feature: GYAE6OF02HWMZL.21.4.A04.1.454.CMB.1.raw
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagtacgttggtccagccgtgggacgggtcctgagactctctgtgcagcctntgcattcaccttnagtcgacctacaacagtcggactcgggtcccgaccgaggtccctaccggaagggggaacgggggtccttaggggaagggttcggggggtacccggtacccggttaaagttaaccggaaaaagggtaaacgtccgttaaaaacgtacggtttaaaccgaacggttaaaccgaaaggtaaacgttaccgggccggtaccgttacgtagggtaacggaaaagggtacggtacctaaaccgtacttcgtaacgaaagtaggtaacgtagtaactttaacgaaaacggtaaaccttacgaacgttagtaacgttcgtaacggaacctaaaagttacggaaaccctacggtaacccgttaaacgggaaaaacccggaacgggtaaacccgaaccggggttccgttaagtttaacgtttaacggttttcgggaacgggttaaaacaaccgtaaaaaagggttacggtagggttaagttcggggttaagggttaccggggtaacgttccggttaggtaacccgg

SEQ ID NO: 146591 - DNA, 1020 bp, Homo sapiens
  misc_feature: GYAE6OF02G27HV.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcggtgggggatacgttggtccagccgtgggacgggtccctggacgtccttcttccgtggtcgaccacggtcccttacgtcgtacctactttcccgtacccttttaccgaggttccgaaacccaaccgaaacctacggttacggggtaaccgttccggggggtacccccgccggaacgggtcccttaccgggaacgggggggtaaaccggggggtccttaggggggtaaccggggtttcggggggttaccccggggacccggggttttaaagttaaacccgggtaaaaaccggggtaaaacgaaccggtttaaaaaccttaacggggtttaaaaccctaacgggttaaaaccaaaacggggttaaaaccgttaccccgggggtcccccggtttacggttacgggtaaacggggtaaaaaccgggggttaaccggggtttaccctaaacccccgtaagtttccccgtaaccggtaaaagggtaaccgtaaacgttaacgttaacgtttaaacccggtaaaaacgtaaacccgttccctaaacgttcgggtttaaactcccgggtttaagaaacccgttaaaacgttaaggtaaacccgtaaccgtaaccccggttaaaaccggggaaaaacccggttaacgggaaccccgggtaaaccggttacccggtttaacgttttaaagttttacgttacggggttaaacggtaaccggtaaaaacggtaaaacgggtttacgggttaaggggttacgtttaacggggggttaggggttacggtttaaacgggtccggtttaacgggtagttaaaccccgg

SEQ ID NO: 146592 - DNA, 774 bp, Homo sapiens
  misc_feature: GYAE6OF02GRW67.21.4.A04.1.454.CMB.1.raw
tcagtcgtcgctcgcacgaccggtgctcgatttagagtagtgatcaggggagctctgagagcggagccccagccccaagaattcccaggtgttttcatttggtgatcagcactgaacacagaggactcaccagtggagtttgggctgagcgtgggttttccttgttgttattttacgaggtgtccagtgtgaggtgcagctggtggagtcgtgggggatacgttggtccaggccgtgggacgggtcccgtaggacgtacctccgtccgtggtacgtccacgtccgttcgtgactaactttccacccttcgacgttacgaacccaactaaactagttacgggaaccgttcggggtcccggaccgacggtccgtaccggaagggggtaacgggcgttacgggagggttcggggtccgtaccgttaagtaaccggaaaggaaacgtacgtaaacgtacggtaactaagtaacgaagtaactaccgggcgtaccgtacgtagggaacggtaaacgggtaaccggttccaaaccgtagttactaaccggtaaaggacgtataacgggtaaacttaccggaaaaacgtaccgttactaaaccgttagttaactcccgtaagtaaacgtaaacgttacggaaaccgtagtacccgaaacgggtaaaaacccgcgggtaaccaacgggtaccgttagttacttaggtcggtacggtaaacgtaacgaaacggttaggacgtaggttcggttagggttactaacggttccggtagttaaccgg

SEQ ID NO: 146593 - DNA, 630 bp, Homo sapiens
  misc_feature: GYAE6OF02IHKM3.21.4.A04.1.454.CMB.1.raw
  modified_base (178)..(178): a, c, t, g, unknown or other
  misc_feature (178)..(178): n is a, c, g, or t
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (492)..(492): a, c, t, g, unknown or other
  misc_feature (492)..(492): n is a, c, g, or t
  modified_base (593)..(593): a, c, t, g, unknown or other
  misc_feature (593)..(593): n is a, c, g, or t
  modified_base (625)..(625): a, c, t, g, unknown or other
  misc_feature (625)..(625): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggtttccttgttgttattttacaggtntccagtgtgaggtgcagctggtggagtcgngggggagacttggtccagccgtggacgggtccctgacgactctcctgtgcagcctntgctattccaccttcagtcaccacaacntggacgttcgggccgacaggcctccggaagggggacgggctggggaggttcggggtccggtaccggttaattaccgaaagggtaaacgctaaacgtaggttaacagttaacgaacgtaacgtacgggcgtcggtctagggtacggaaaagggtacggtttccaaccgtacttacgtacgaagaagtactagtaacgttanaaaacggtaacctctaaacgttgtaactctaggaacaaagtacgaacacgtcgtaaacgaaaccgacggacgacggtcgtagttattaggttgtaggtaanaagaaggagtaggagtagtcggtaggtagtcngtacg

SEQ ID NO: 146594 - DNA, 654 bp, Homo sapiens
  misc_feature: GYAE6OF02JSGY4.21.4.A04.1.454.CMB.1.raw
  modified_base (199)..(199): a, c, t, g, unknown or other
  misc_feature (199)..(199): n is a, c, g, or t
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (526)..(526): a, c, t, g, unknown or other
  misc_feature (526)..(526): n is a, c, g, or t
  modified_base (648)..(648): a, c, t, g, unknown or other
  misc_feature (648)..(648): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaccaccggagaaattgtgttgacgcagtctccaggcaccctgtctttgtctccgaggggaaancgcctaccctctcctgcagtctccagacccaagtaactaactcccaggacgtacttaacctacactacggaccccttagggtaacccaggacctaaggaaaccggcccgttagggacccctaagggccctaccccgacgggttttcccctacgaattccttagtccgccggttccgggtaccccagacgggtacccacgtggcacgtacccagactacggttgaacgttcgggntacggtgggctgggacaatcctanctctcgatctatacgacgtacgcgtaggcgtacgtagtacgtattccggattagtattactattcgtanaggtacgagttagttacgaattccgtaaccttcgtagggtcccgttacgggaccgtaacggtacgtaaacggtcgaaaggtaccgtaaatacggtggttacgactggaccctactacggttntacccg

SEQ ID NO: 146595 - DNA, 685 bp, Homo sapiens
  misc_feature: GYAE6OF02JX50U.21.4.A04.1.454.CMB.1.raw
  modified_base (113)..(113): a, c, t, g, unknown or other
  misc_feature (113)..(113): n is a, c, g, or t
  modified_base (345)..(345): a, c, t, g, unknown or other
  misc_feature (345)..(345): n is a, c, g, or t
  modified_base (390)..(390): a, c, t, g, unknown or other
  misc_feature (390)..(390): n is a, c, g, or t
tcagtcgtcgctcgcacgaccggtgctcgatttagagtagtgatcagggaggagcgtgctcagttaggacccagagggaaccatggaacccagcgcagcttctcttcctcctnctactctcggctacccaggctcacgaaaccaccggagtaaattgtagttgacgcagtcctcaggcacctgtctttgtctccgaggggaaagacgtccacctctccctagccagtctccagccgacgaatactccaagtagtcctactacgactagcctacggtaccacgactagaacgcctcggactacggcctaccgacggttcctctatcgtatacgctacgggtacccncgtacgggccacggtcggactacgtcccgagaacgtaccggttanacggttcgaccgtaagggtcgggtctacgggtacaacgtactttcccgactacgtacctactacgtaacttaggactacggtacgtcggtacgaccgttagtaaacgtagtttcggactaaggttcgtaacttacgtacgttacacggtatacggttatacgggtaacgttaccgtaaccgttcgttcggttaccggttccgtacggacggtaccgtaaacgggtataaacggtaacgtaacggttaaccggttagtacgggttaccacggttacaccgttacggtaccttacgg

SEQ ID NO: 146596 - DNA, 725 bp, Homo sapiens
  misc_feature: GYAE6OF02HQ8AN.21.4.A04.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtagttgacgcagtctccaggcaccctgtctttgtctccgaaggggaanacgcctaccctctcctcgcagacctccgaagccgaanaatactccaaggtacaccttactaacctagtaacggtccgttaacggtaccagacgaagtaacgcccgtcggaccgtaacggcctaccgtacggtttacctactacttacttacgtaggtccgtacgggttcccacggacggtacctacggtcgtcaacctaccgagaacgaggttcaggttagccggaggttcggtcgtagggctacgtactcgactcgtaactagtatacttaacggcgaaacgtacggtacggtaacggtaacccgttggtaaacggtttacgttcgaaccggttaagttaccgtttaagtttacggtacgttacgaagtaacggtaacgttaacgtagggtaaccttacgtacgttacggttactaccgggtttacgaacggtaacggtaacgtaaacgggtaacgaaacggtaagtaaaccgttaacggtacgtacggtacgtacggaaccaacgttcgttacgttaccgg

SEQ ID NO: 146597 - DNA, 818 bp, Homo sapiens
  misc_feature: GYAE6OF02JIYQL.21.4.A04.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaantccacctntcctgcagctccagccagaatactccagacnctactacatacgcctggtaccagcaagaacgccgtggcccaggcctcccgaaggtttccctacgacttcttacgtgccgttcggggttacccacgacgggcccaacgtggacctacgtccccgaaggtacctaggttcaacgggttcggaccgtagggttgggtacttacgggggaacctaacggggttaccctttaccgtaacccgttccgtttacgtaacgtttacctaaacggttttacggaccgttaacggtaaccggttacgggaacgtacccgttaagggtaaacggttaacgttttaccggacgttaaacggtttacgtttaaaccgttttaccgttacggttaaccgacggttaaccgtaaggtttaacgtttaacggggttaaacgtttacccgttaacccggttcgtttaccggtttacccgggtttaccgggtaacccgggtaaacggggttaaacccgtaaaacggggtttaaacgggaaaactttaaccggggaaaaaccgttaaccggttttacggttaccgggtacgttaccggtaacccgtaacccgttaccgtttcgttaccgg

SEQ ID NO: 146598 - DNA, 704 bp, Homo sapiens
  misc_feature: GYAE6OF02GDFOP.21.4.A04.1.454.CMB.1.raw
  modified_base (201)..(201): a, c, t, g, unknown or other
  misc_feature (201)..(201): n is a, c, g, or t
  modified_base (552)..(552): a, c, t, g, unknown or other
  misc_feature (552)..(552): n is a, c, g, or t
  modified_base (696)..(696): a, c, t, g, unknown or other
  misc_feature (696)..(696): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanatccaccctctcctgcagcctccagccaagaactactcgagacgtctaactatatacgtccgtaggaccagcaagaacgccgtggacccgacggtccctacccgtacggttccctactaacttcgttacgtcggtccggttccggggtacccaacggtacggggaccctacggtcggacctaccgtacccgagaccgtacggttcgagggtcggacgtagggttcgggtcgtacgggactaacgttaccttaccgacttcctactacgttactaacgtacgacgaaggtccgtaggaccgtaccgtaggtaacgttacttccggagttacgttacgttaattacgtcgtanaacggtcgtaagttacgtagggttaaccttacctccgttcgttacgggttaccggttaccggaacggtaacgggtaaccggtaaaggtaaacgtaacgtaaacgggtaaacgtaacgtggtacggtactccggtaactaccgtntcgttacg

SEQ ID NO: 146599 - DNA, 682 bp, Homo sapiens
  misc_feature: GYAE6OF02FPS2X.21.4.A04.1.454.CMB.1.raw
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (255)..(255): a, c, t, g, unknown or other
  misc_feature (255)..(255): n is a, c, g, or t
tcagtcgtcgctcgcacgaccggtgctcgatttagagtagtgatcaggggagagctgctcagtttaggacccagagggaaccatgggaaaccccagcgcagcttctcttcctcctgctactctggctcccaggctcagaaaccaccgganaaacttgtgttgacgcagtctccaggctaccctgtctttgtctcaggggtaaanctccacctctcctgcagctccagccagactatccagacgctactacagtancctggtaccagcagaacgcctggccaggcctacccaggttccctcgtatccttaagtggcctcgggtccccagacgggtccacgtggccactcccgagacctaggtttccaggtcggctaaggtcggggtacctggggaactaggaacctttccaacgttctaccattcgtaatttacgactaacggtacgttagggaccgtccgttaggaaacgtacgttttaccggacctaagggtttacttaacgtttacgtacgttacgacggtactaagggttacttacgggtaaacgttccgttaacctcgttacgttaccggttaccggaccgtaagggtaacccgtaagggttaaacgaaacgtaacgggtaaaaccgtaacgttacggtaacggtccgttaacggccctaaccggtacttacgttccg

SEQ ID NO: 146600 - DNA, 628 bp, Homo sapiens
  misc_feature: GYAE6OF02FWV4J.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaactatccagacgctactacatacgcctggtaccagcagaacgcctggccaggcctcccgaggttcctcatctatcgcgtcgggtcccagacgggccacgtcggactactcccgaagtaccgtaggtttcaggtcggctagggtgggtcgtgggactagtaccttcacttctacatactatacgcaacgtacgtaggacgtccgtagtaacgtctttaccggacgtagttagttacttaccgtgtacgagtacgtaaggttagttacggtaacgttcctaccgttcgttacggttccgggttaccggacccggtaacgggaccgtaaagggtaacgtaaacggtaacggaaaccggtaacgttggtacggtcgtacggaccctaacgtacgttcgtacg

SEQ ID NO: 146601 - DNA, 819 bp, Homo sapiens
  misc_feature: GYAE6OF02F6OSQ.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaancgccaccctctcctgcagcctccagcccaagaatactccagacgtctacctacatacgccctggtaaccaggccaaggaacgccgtggcccaggcctccccgaggttcctacgaacttctatcgcgtcgggtaccccacgacggggccctaacgtcgggacctaacgtccccgaaggtacctacgggtttccgagggtcgggaccgtaggggtttcgggggttaccgtagggggaaccctaacggttacccgttttacggaaccctttccgttaacccaagttaccgtaacgtttacggaccgtaacgggtaccgtacgggtaaccggtacccgttaagggtaacggttacggtttaccggtaccgtaaagggtttcgttaaacgtttaccgttacggttacgtaacggtacgtaacgggttaacgttacggggttaaaccgtttaccgtaacccttacggttcgggttacccggtttaccgggtaacccgggttaacggggtaaccccggtaaaggggttaaaccggtaaaacgggttaacgggtaaaaccgtaaccggttgggttaacgggtaccgttacgggtaacccgtaccgttaacggttccgttaacccgg

SEQ ID NO: 146602 - DNA, 779 bp, Homo sapiens
  misc_feature: GYAE6OF02HT80I.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanagcccaccctctcctgcacgcctccacgaccaagtaaactatacccgaagacgtacctaactaacaacgtacgccttacgggtaaccaacggcaacggaaacgcccgtacgggacccgaacgggtcccttaccccgtaacggtttcccctactaacttccttagtacggcgttaccgggtaccccaacggacgggacccacgtcggacctaccgtacccgaagaaccgtaggttacgacgggttcgggacgtacgggttacggggtcgtacgggggaacctaacgtaccgtttacctaaccgtttactaccgttaactaccgtaagttacggtaccgtaaggtaaccggttcggaacgtaccgtaaggtaaacgtacgtttaccggtacgttaggttcgtttaagttaacgtcgtacgtacgtacgtaagttacgtagggtaacgtttccacgtttacgtcggttaccgttaccgggacgtaacgggtaaccgtaaagggtaacgtaaacggtaacgtaaaccggtaacgtcggtacggtccgttaacggtaaccgtaaccgtacgtttccgttaacg

SEQ ID NO: 146603 - DNA, 887 bp, Homo sapiens
  misc_feature: GYAE6OF02HM5FP.21.4.A04.1.454.CMB.1.raw
  modified_base (93)..(93): a, c, t, g, unknown or other
  misc_feature (93)..(93): n is a, c, g, or t
  modified_base (151)..(151): a, c, t, g, unknown or other
  misc_feature (151)..(151): n is a, c, g, or t
tcagtcgtcgctcgcacgaccggtgctcgatttagagtagtgatcaggggagagctgctcagttaggacccagagggaaccatggaaaccccngcgcagcttctcttcctcctgctactctggctccaggctcagaaccacggagaattgngttgacgcagtctccaggccacctgtcttgctccgaggggaatacgccacctctcctgacagcctccagtaccagtaatactccgaggtacacctaacgtacgaattacgacccgttagggtaacccaagtccgaaagacggcccgtaggacccacgggtccttacccggtacggttttaccctccgacttacctacgtccggtccggttccggggttaacccccaacgggtacgggggtacccctacgggtttaccggaccgttaaaccggtacccgaaacgggtaccggttaaccggtttcgacggggtaccgggtaccggtaggggtttacggggttcgtacgggggaaccttaacggttacctttaccgaccgttattacccgtacgtaacgtttaacttaaccggtaaccgtaaacggtaccgggttaacggttaccggttaacccggttaacgggtaaaggttaccgttttacggaacggttaaggtttacttaaacgtttacggttacgaaccggttaacgacgttaaggttaggtaacgggttacctttaccggttaacccgtttcgggttaaccggttccggttaacgggaaccggtaaaccgggttaaaccgttaaggggtaaacgtaaacccgggtttaaacgggtaaaaccggttaccggtttaagggttacccggttaaaccgtccggtaaccgttaacccggttacgtaccggtttaacccg

SEQ ID NO: 146604 - DNA, 655 bp, Homo sapiens
  misc_feature: GYAE6OF02HIYQB.21.4.A04.1.454.CMB.1.raw
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttattttacaaggtgtccagtgtgaggtgcagctggtggagtcgtgggggatacgttgggtccagccgtgggacgggtccctgacgacctctcctgtgcagcctntgcattccaccttcagtcgaccacaactntggactcgggtcccnccgaggcctcgaggggacgggcgtggaggtcgggtcggcgtagttaacgaaggaacgtacgtaanagttacgagtaacaaggaatacgggactcggtctaggtacggaaaggtacggttaccaccgtaattcctacgaaagacgtatagattaagaaaagactactagttagacttccgagaacctaaagtacaacgtaacgacccgtaaaggaaaacccgtagggaacccaccgggtacgttacgttaacgttttagttacgggtaaggaacgtaaaacgtaaaaggtcgggttaaggtaggttacggttagggtagggtttaacggcggttagtaacccgg

SEQ ID NO: 146605 - DNA, 834 bp, Homo sapiens
  misc_feature: GYAE6OF02G9BWR.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtctgggttttccttgttgttatttacaaggtgtccagtgtgaggtgcagctgggtggaggtcgtgggggagtacgttgggccaggccgtgggtaggggtcccctggacggtaccttccgtccctgtcgcacggtccctgtcgactacttcctaccgtttcacggtcgaacccaacaacgaagtcgggacgtcggggtccccaccggacggcccgtaccggaagggggtaacggggccgtgggtacgggttcgggggtcccgtaccggttaagttaaaccggaaaggaaaccggtaccttaaacgtaacggttaacaaggtaaaccaaggtaaaccgtacgggccgtaggttccggtaggttaaagggaaacgggtaaccggttaccaacccgtaacttaccgtaaccgtaaaggtaggtagttaaggtaacctttaacgaaaaacggttaccctttaacggtaacccgttagtttaacgttaccgaacgggttaactaaaacggttaccgaaacgtaaccgggtaaccctaaacgggaaaaaccccgggtaagacccgtaaacccgggtcggtttaagttaacgtttaccggttaggttaaccgggtaaagtaacccggtaaaaagggttacggtaaagggttagttacggggttacggttagggtaccggttaggtaccgttacgg

SEQ ID NO: 146606 - DNA, 689 bp, Homo sapiens
  misc_feature: GYAE6OF02HPA48.21.4.A04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (435)..(435): a, c, t, g, unknown or other
  misc_feature (435)..(435): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtctccaggcacctgtctttgtctcgaggggaaangccacctcnctgcagctcagcctagaactatccgaagacgcctaactacaattacgcctaggtaccaagcaaggaacgccgtacggccaggtcctacccgaaggtttccctacattcctaagttcggcgttaccgggacccaacgcgggtccacgtacggccacgtcccgagaccgtacggttacaggtaggcgtaaggttcgggtcgtagggacctagtaccttcgactcgtanactcgtattacgacgagtacggtacggagtacctaggtaaacgttcgtttccgaacttaggtactttacgttactacggtacctacgtacgtaaggttacgtaacgggttacctttacgtaaccgttcgtacggttaccggtttaccggaaccgggtaaacgggtaaccgtaaaacgggttaaagtaaaccgtaacggtaaaaccgtaacggtggttacgaccgttaggacccttaacggtactacctttacgg

SEQ ID NO: 146607 - DNA, 797 bp, Homo sapiens
  misc_feature: GYAE6OF02I6HGS.21.4.A04.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcaacgaaaccgaccggagaaattgtgttgacgcagtctccaggccaccctgttctttgtctaccgaaggggaaancgcccacctctccgtgcacgcctccgacggtcccaaggtaaactactacccgaagacgtacttaactaacgaacttacgccgttacgggtaacccaggaccgaaggaaacgccgtaccggaccgaacgggtcccttaccccgtaagggtttccccacttaacgttacttacgtcggtcccgttaccgggggtaccccaacgggtaccggggaccctacggttcgggacctaaccgtaccccgaaggtaaccgtacgggtttaccagggttcggaccggtaggggttcgggttaacggacggggtaactaacggttacctttaccaccgtttcctacgtactaccgtaacgttaacgacgtaacggtacgtacggacgtaccgtagtaacgttacgttacgacgttagttacgttaacgttacgtacggtacgacgtacgtaagttacggtacggtacgttacctacgttcgttacggttacgggttaccggtaacggtaaccgggtaacgtaacgggtaacggtaaacgtaacggtaaacggtaacgtaggtacggtacgtacgtaaccgtacttacgtcgttaaccg

SEQ ID NO: 146608 - DNA, 678 bp, Homo sapiens
  misc_feature: GYAE6OF02H3BFD.21.4.A04.1.454.CMB.1.raw
  modified_base (481)..(481): a, c, t, g, unknown or other
  misc_feature (481)..(481): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtgggggagtaccgttggtccaggcccgttgggacggggttcccctggacggtacttccgttccgtggtcgcagcccttctgtcattccaccttcagtcgaccacaacagtcggactcgggtcccgcacggctaccgaggggaacgggtcgtgggacggtcgggtcggaccgtaagttacgaacggtaaacgtctaacgagttacgagtaacaaggacgtacggccgtcgtacgtagtaggaaacgggtagttccaaccgtaatccaacgaaagngaacttacggaattaacaaaagtaaacctctaacgtagttactacgtacgaataaacgtacgaaccgtcaaccggtaacgaaaacgtaccggacgtaccgacgttgttacttagttaggaacgggtaactaaacggaaagggtaagttcgggtaagtacgggttaccggggtagtttaccggaggtacgttaacggg

SEQ ID NO: 146609 - DNA, 742 bp, Homo sapiens
  misc_feature: GYAE6OF02JG474.21.4.A04.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacggagaaattgtgttgacgcagtctccaggcaccctgtcttgctccaggggaaangccacctntcctgcagcctcagccagtaatanccaagnctaactacatacgcctggtaccagacagaacgcctggccaggctcccgacggtttccncatctaatcgccgtcgggtacccacgacgggcctaacgtggacctatcccctaagacctacggttaccgaaggttcggacgtaggttcggggttcgtaggggaaccacggtacgtttaccaacgttcctactacgtacctaacgtttaacgacgaaaggtaccgtagggtacgcccgttaaggtaaagtacgttttaccgaccgtaaggttacgttaaccgtttacgttacggtaccgtaacggtccgtaaaggttaacggttacggggttaaactttacccgtaaaccgtttccgtacgggtttacccgggtttaccgggtacccgtaaaggggtaacccgtaaacgggggttaaacgtaaaaccgtaagggtaaaaaccccgtaaggtttaacgggtacgggtaccggtaacgtacccgtaaccgttaggttaccctttaaccggg

SEQ ID NO: 146610 - DNA, 903 bp, Homo sapiens
  misc_feature: GYAE6OF02J0R7L.21.4.A04.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaanacgccacctctcngcagctccagccagaatactaccgagacgtacctaactacgatacgccttacggtaaccagacaagaacgtccgtaggaccctagggcccttacccgtaggttccctacgtaactacgttaacgtcgtccgttaccggggtaccccacggaaccggggtcccaacggttcggaccctacgtcccgaacggtacgtacgggttacgaacgggtcgggtaccgtaggggttcgggtacgttacgggaaccgtaacgttaccgtttccgacttccgtacgtactacgtaacgttagaccgtaaggtaccggtaggtaccggtaccgttaacggtaaacggtttaccgtttacggttaccgtaaacggtttacgtttaaaccgttttaaccgttacggtaaccggtaacgggttaacgttaaacggttttaacggttaacccggggttaaccggtttaacccgttaaccccggttttcgggtttaacccgggttttaaccccgggggtttacccgggtaaaacccggggttaaaccgggggttaaacggtttaaaaccgggggtaaaaggtttaaaaacccgggttaaccggtaaaaaacccggggtttaaccggtttacgggggtttaacccgggtacggtttaacccgtaaaccccggtttaaccggtttacgttttacccggttttacccgg

SEQ ID NO: 146611 - DNA, 724 bp, Homo sapiens
  misc_feature: GYAE6OF02I1LSR.21.4.A04.1.454.CMB.1.raw
tcagtcgtcgctcgcacgaccggtgctcgatttagagtagtgatcagggggagagctgctcagttaggacccagagggaaccatcggaaaccccagcgcagcttctcttcctcctgctactctggctcccaggctcagaaaccaccggagaaattgtgttgacgcagtctccgaggccaccctgttctttgtctccgaggggaaagacgccaccctctcctgcagctccagccagaatactccagacgctaactacatacgcctaggtaaccagcaagaacgtcctacggcccaggtcctcccgtaggttcccacgtacttcctagtcggtccgtcggggtacccaacggtacgggcccacgttcgggcctaacgtacccgaagtaccgaggtttcgaggttacggccgtagggtacgggtcgtagggactacggtacttccgaacgtccttacgaacgttactaacgttacgccgtaacggtaccgtagggtaccgtaccgtaggtaaacgtacgtttaccggtacgtacggttagttaacgtttacgttcggttaccgagtacggtaagttacggtacgttaacggttaccgttaccgtttaccggtcggttaccgttacgggacccggttaacgggtaaccgtaagggtaaggtaaacggtaacggtaaaacggtacgtagggttacggtacgtaacgtaccgaacttacgttattaccgg

SEQ ID NO: 146612 - DNA, 864 bp, Homo sapiens
  misc_feature: GYAE6OF02G9UNM.21.4.A04.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaacccatggaaaccccagcgcagcttctcttccctcctgctactctggcctcccaggctcaagaaaccaccgganaaattgtgttgacgcagtcctccaggcaccctgttctttgtcctaccgaaggggaaanacgcccaccctctcctgccagctaccgagaccagaactactccagacgctactacatacgcctaggtaccagcaaggaacgccgtacggaccacggccctacccgacggtttccctacaacgttcctacgtcggtaccgttccggggtacccccaacggacggggtaccccaacggtccggacctaccgttaccccgaaggaccgttacggtttccgacgggtcggaccgtaggggttcgggttaccgtacggggaactaacgggtaaccctttcgaaccctttcgtaccttaacggttacctaaacgtttacggaccgtaaacggtaccggtacgggtacgtacccgttaaaggtaaacggtttacggtttacccggaagtttaccggtttaacggtttaacctttaaccgggttcggtaacccggtaacggttacggttaaaccggttttggtaaaccgggttaccgtttacccggttaaccctttaccgggttaccggttaccggggtttaacccggaacccgggtaaccggggttaaaccggttaaaaggggtaaccggttaaaaggtaaacccgggtaaaacgttaaccggttcggttaaccgggaaccggttacctaccctaacccggttacgttaccctttaaccgg

SEQ ID NO: 146613 - DNA, 579 bp, Homo sapiens
  misc_feature: GYAE6OF02FZNP5.21.4.A04.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (369)..(369): a, c, t, g, unknown or other
  misc_feature (369)..(369): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgtctcaggggaangccacctntcctgcagcctccagccaagaatatccagacgctaactacatagcctggtaccagcagaacgctggccaggctcccaggttccncatctatcgctgggccacgcgggccagtggcactccagacaggttcagtggctaggtgggtctgggacagtacttcactcnctatctattagcagtacgtggacgctagaagtagtttcgacgtagtagttattacgtgtacagtcgtaagttacgtaggttaacgttaccgtaccttcgttacggttccgttacggtaccgaacgggtaaccgtaaacgggtaacgtaaacgttaacggaaaacgttaacgtaggtacggtaccgtacggactaccgtacttacgttacg

SEQ ID NO: 146614 - DNA, 740 bp, Homo sapiens
  misc_feature: GYAE6OF02H9QEP.21.4.A04.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagctgggttttcctgttgtattttacaaggtgtccagtgtgaggtnctagctgggtggagtcgtggggganacttggtccagtccgtgggacggtcctgacgctcctctgtgcagcccgtatcgcctattccaccttgagtacgaaccctaanaactgtcgggtacctggggtcccacgaggccttccgagggggaccggtntacgggagtcggggcgcgttatacgaaggaanctaacgaggttanaagtacaagagtacgcgtcgtgtacgtagaaacggtaggttccacgtaagttctaccggaaagtacgtaagttacgaaccgttaacgaaaaacggtacccgtttaccaacggttttagaaccgttacgtacgggtaaccttaaaaaggtacgttaacccgaaggtacccggttaaccgggaaaaaaccggttccgggaaacttaaacccggggggtaccctttaggttaaccctttggttttaaccgggtaaggggtttaaaacccaacggaaaaggtttaaacgggtcgggttaaaactttccgggggtttaaggttacccgggaacggtttggtagttaaacccggg

SEQ ID NO: 146615 - DNA, 626 bp, Homo sapiens
  misc_feature: GYAE6OF02JEK0P.21.4.A04.1.454.CMB.1.raw
  modified_base (198)..(198): a, c, t, g, unknown or other
  misc_feature (198)..(198): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccagggaangccacctctcctgcagctccagccagaatatccagagctactacatacgcctggtaccagcagaacgcctggcccaggcctacccgagggttcccncaattctaagtcgcgttcggggtaccccagacgggcccagtcggctactcccgaagacctaggttccaaggtcggactaggtcgggtactggggacctaggtacttcgacttcgtactatctattacgcgtaacgtacgtaggacgtccgtaggtaacgtacgtttcgacgtagttagtattacgtcgtctagcgtagttagtacggtaacgttccgtaccgttcgttcggttcgttaccggaccgtaacgggtaaccgtaagggtaacgaaacgtacggaaaccgtaacgtaggtacggtaccgttacgaccgtaacctacgttccttacg

SEQ ID NO: 146616 - DNA, 640 bp, Homo sapiens
  misc_feature: GYAE6OF02G52Z1.21.4.A04.1.454.CMB.1.raw
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggacgggtccctgagactctcctgtgcagcctctgcattcaccttcagtcgaccacaacngtggactgggtccgccaggctcgaggggagggctgggagtcgggtcgccgtatacgaaggaancgtaacagttacagtacagaatacggcgacgtgtaggtagaaagggtaggttacaccgtatccgtagaaaggagtagtacgaacttaccgaaaagtaccgtactaacgttgtaacttctagaacctaaagttaccggaaacacgtacccgttaacgggaaaaacccggtgggtaaaccgtaccgggaccgtttaggttacgttttacggttagggtaagggtaaacgaaacgtaaaggtaccggttaggtaacgttgggtaggtagggtacgttcggtaggtaccgg

SEQ ID NO: 146617 - DNA, 680 bp, Homo sapiens
  misc_feature: GYAE6OF02H6E7R.21.4.A04.1.454.CMB.1.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (395)..(395): a, c, t, g, unknown or other
  misc_feature (395)..(395): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggccacctgtctttgtctcgaagggaancgcccacctctcctgcacgcctccagccaagaactactccagganctaactacatacgccttaggtaccagacagaacgcctaggccaggcctccgtagttccacactcgtatcgccgttcggcccaggcggccacgtgcacgtccaagactggtacaggtcgagtaggtggcgtagggactagtccttcgactctntactactactacgcgtaacgtacggtcggacgtaccggtagaacgttagttccgacgttaggttacgttaacgttacgtacggtactaggtacttaaggttaacggtttacgtaaccgtttcccttaaccgggttcgttaccgggtttaccggtacccgggtaaccgtaacgggggtaaccgtaaaacggggttaaggtaaaaccgtacgggttaaaaaccggttaccgtacggggttaccggtacggtaccgtaacccggtacgttaccgtttaccgttaccgg

SEQ ID NO: 146618 - DNA, 852 bp, Homo sapiens
  misc_feature: GYAE6OF02FPU5L.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtgggggagacttgggtccaggcctgggacgggttccctgagactcctcctgtgcagccctctgctattcaccttcagtgacccacaactagtacgggacgtgggtcccgccgacggtcctaccggaagggggaacgggggtcctagggggtaggttcggggttaccgggccgttaagttaaccgaaagggaaacgtaccttaaaacgtacggttaaccgaacgttaaaccaaggtaaacgtaccggggacctccgggtacgttcgggtaaacgggaaaaggggttaaaccggtttaccaaacccgtaagttcccgtaaacggtaaaggtaagtaaacgttacgtaaacgttttaaacccaaaaaaggttaaccccttaccgttaaacttacggttaaccttaccgtacggtaaaccaaaaacggttacgggaaaacccgtaaccggttaacccgtaaaccgggaaaaacccgaaacgggtaaaccccgtaaaccgggggttcccgtttaagtttaacgttttaacggttttaaccgggtaaagggttaaaccggtaaacggtaaaaaagggttaccggttaaggggttaacgttcgggggtttaaggggtttacggggaacggttttcgggtacgttaaccgg

SEQ ID NO: 146619 - DNA, 969 bp, Homo sapiens
  misc_feature: GYAE6OF02F5AJG.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtgggttttccttgttgttattttacaaggtgtccagtgtgaggtgcagctggtggagtcgtgggggagtacgttggtcccagcccgttggggacggggttccccctggaacggtaccttctcccgttggtcgcctaacggcccttcgtgcctactttccacctttcaggtcgaaccctaacaaactaacgtcgggtaccgttcggggtcccccgacccgacgggtccctacccgggaaaggggggaacggggggtccgtagggggtagggttccggggggttccgggtacccggttaagtttaaaccggaaaagggtaaaacggtaccgttaaaaacggtaacggtttaaaccgaaacgggttaacgtaaaacggtaaacggtttaaaccccggggccgggttaaccggtttaccggttaagggtttaacggggaaaaacgggggtttaaccgggtttaacccgtaaccccgttaaacgtttacccgtaaaccggtaaaagggtaacgtaaacgttaggttaaaacgtttaacccggaaaaaacgtaacccgtttaaccgtaaacgtttacggttaactttaccggttacggtaaacctaaaaggttaccggaaaaccgtaacggtaaccccgtaaaacgggtaaaaaacccgggacccggtaaaccggtaaaacccgggggttccgggtttaactttaacggttttaacggttttacgggttaaacgggttaaacggtaaaaccgggtaaaaagggtaagggttacgggtaagtttggggtttaacggggttgggtaacggttccgttaggttaccggg

SEQ ID NO: 146620 - DNA, 732 bp, Homo sapiens
  misc_feature: GYAE6OF02H8JQN.21.4.A04.1.454.CMB.1.raw
  modified_base (213)..(213): a, c, t, g, unknown or other
  misc_feature (213)..(213): n is a, c, g, or t
  modified_base (388)..(388): a, c, t, g, unknown or other
  misc_feature (388)..(388): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttggggctgagctggttttccttgttgttattttacaggtgtccagtgtgaggtgcagctggtggagtctggggganacttggtccagcctgggacgggtccctgacgacttctcctgtgcagcctctcgcatttcgacctttcgacgttcgaccactaaaccatcggacttcgggtccgccgaaggctccgaggggaaggggctggggaggttcgggtcggaccgttattaccgaaaggaaacgtctaaanacgttaacagttaacgaagaacggtacgcgtacgggtctagggtacgaaagggtaaggttccaacgtacttcgtaacaaggactagtaggaacgtttaacaaaacggaacctactaaccgttagtttaacgtactaccgggtaaaaacgtttacggaaaccgtacgtaacccgttaaccggaaaaaacccgggacgggaaaccgtaaccggggtacccgtttaaggtaacttttaagggtttacgttaacgggtaacggtaaacgtaaaaagggtttacgggtaagggtactttacgggggtagggtttaacccggggttagttaccggttaggttaacccggg

SEQ ID NO: 146621 - DNA, 826 bp, Homo sapiens
  misc_feature: GYAE6OF02HW7UU.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccaccctgtcttttgtcctacgaggggaaagagccctaccctctcctgcagcctccgacgaccaagaatactacccgaagacgtcctaactaacagttacgccgttacggtaacccagaccaaggaacgccgtacggcccgaggccctccccgtacggtttccctcgtattccgttacgtcgtccggtcgggtaccccaacggacgggtacccacggttcggcctaccgtaccccgacggtaaccgttaacggtttcgaacggtttcgggacccggtaaggggtttcggtaccggttcggggaacttaacggtaccttttacggcccttacccgttactaacgtttaccgtacgtttaacggaacgttaaacgggaccggttacggggtaccgttaaccggttaaggttaaaccggttacgtttaccgtaacgttacggttttacgttaaacgtttcgtcggtttaaccaggttaacgttaagggttacgttaacgggttaaccgtttccgttaacccgggtttcgtttccggttacgggttacccgggtaaccgggtaacggtaaccggttaaacgggtaaacgtaaggaaacgggtaacgttaacggtcggtaggtaccgtacggaccgtaacgtacgttacgtttaccg

SEQ ID NO: 146622 - DNA, 824 bp, Homo sapiens
  misc_feature: GYAE6OF02GUAJW.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagacgccacctctcctgcagctccagccagaactactaccagacgctaactacagtacgccttaggtaaccagacaagaacgccgtggacccacgggcctaccccgtacggtttccctacgtacgttaccttagtcggtcccgttacggggtaccccaacggacggggtaccctacggttacgggaccctaacgtaccccgaaggtaaccgtaacgggtttcgaacgggttcgggtaccgtaacggggtttcggggttaccgtaacggggggtaacctaacgggttaacccgtttacgaacccgtttccgtaaccgttaacgttaaccgttaaacgtttacggaaccgtaacggtaaccggttacggggtaacgtacccggttaaggtaaaccggttaacgttttcccggaacgtttaacggtttacgtttaaccgtttacgttaccggttacgtacgtaaccgttaaggtttacggtaacggtttaaccgtttaccgttaccgtttcgttacggttacggttaccgggtaacccgtaacgggtaaccgtaaagggtaaacggtaaagtaacggtaaacgttacggtaggtacgtacggtacgtacctacgtacgttagttaccg

SEQ ID NO: 146623 - DNA, 817 bp, Homo sapiens
  misc_feature: GYAE6OF02H24BF.21.4.A04.1.454.CMB.1.raw
tcagtcgtcgctcgcacgaccggtgctcgatttagagtagtgatcagggggagagctgctcagtttaggacccagagggaaccatggaaaccccagcgcagcttctcttcctcctgctactctggcctcccaggctcaagaaccacggagaaattgtgttgacgcagtctccaggcaccctgtctttcgtctaccgaggggaaacagcccacccttctcctgacacgcctaccagccagtaacttactccgaagacgctaactacgacttacggccttcggtaaccagcgaaggtaaccggtccgtggcccgaaggcccttaccccgtaggtttacccacgtacttcgttacgtcgccgttccggggtacccaacggtcggggacctaccggtaggccaaccgttccccgaaggaccggttacggtttacgacgggtggggtacctaggggtttcgggttacggtacgggaacgttacggttaccttcgtaaccgttccttacggtattacgtaacgttaggtaccgtaggtacccgtagggtaccgtaccggttaggaacgttttacggttacccgtaaggttacggtttacgttaaaccgtttttcggaccggtttaacgaccggtaacgtttaacgggttacgttaccgggttaaccgttacccgtttcgtttaccgggcggtttttaccgggtcccgggtaacccgtaaggggtaacccggttaaagggttaacgaaaacggtttaacggaaaacggttccctaggggttaccggacgttaaccggccccgtaacggttacttccgttacccg

SEQ ID NO: 146624 - DNA, 689 bp, Homo sapiens
  misc_feature: GYAE6OF02IBY7Q.21.4.A04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaangcccacctntcctgcagctccagccagaactatccaagagacctactacatacgcttggtaccagcaagaagcctggccaggcctacccgaggttcctcactcttatgcgtcgggtaccccagcgggccacgtgaccactcccagactacggttcaggtcggtcgaggtcgggttcgtacggggacacggtaaccttcgaaccttccgttaccgtaattaccgtaagtttaacggacgtaaggtaaccgttacgggaacgtacccgtaaggtaacggttacgttttaccggacgttaacggttacggtttaactttacgttaggtaccgtaagtaccgtaaggtttacgtaagggttaacgttaccgtaccgttacggtttcggttccggtttaccggaccgtaacgggtaacccgtaaagggttaacgtaaacgtaacggtaaaccggtacgttacggtacggtctacggaccgtactacgtgttaccg

SEQ ID NO: 146625 - DNA, 758 bp, Homo sapiens
  misc_feature: GYAE6OF02I81G0.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggctacctgtctttgctaccaggggaancgccaccctctcctgcagcctccgagaccaagaactactccgagacgtacctaacctacaacttacgccgttacggtaacccagaccgtaaaggaaacggtcccgttacggggacccctaagggggtccccttacccccgggtaacgggtttttccccctaaccgtacgtttacccttaaggttccggtccggtttacccgggggtacccccaaccgggaccggggggtacccctaacggttcgggaacctacccgttaaccccggaaaggtaaacccggttaacggggtttcccgtaaggggtaccgggtaccggttaacgggggttttcgggggtaccggttaggggtaacctaacgggtttacccttaccgtacctttcgtacctaattacgtactttacgagtaacgtacgtaggactcgtaagtacgtacgttcgagtaaggttctaacttcgttacgcgtagtactagttgtagtactctaccgtgtcgtcgtacgactaggactaaggtataaggtacgaacgtctaggtcgtacgcactacgtactgtacg

SEQ ID NO: 146626 - DNA, 698 bp, Homo sapiens
  misc_feature: GYAE6OF02FUVJJ.21.4.A04.1.454.CMB.1.raw
  modified_base (274)..(274): a, c, t, g, unknown or other
  misc_feature (274)..(274): n is a, c, g, or t
  modified_base (558)..(558): a, c, t, g, unknown or other
  misc_feature (558)..(558): n is a, c, g, or t
  modified_base (575)..(575): a, c, t, g, unknown or other
  misc_feature (575)..(575): n is a, c, g, or t
  modified_base (688)..(688): a, c, t, g, unknown or other
  misc_feature (688)..(688): n is a, c, g, or t
tcagtcgtcgctcgcacgaccggtgctcgatttagagtagtgatcagggggagagctgctcagttaggacccaggagggaaccatggaaaccccagcgcagcttctcttcctcctgctactctcgctcccaggctcacgaaaccaccggagtaattgtgttgaccgtcagtcctccgacggcctaccctgttctttgtccttaccggagggggaaacgtacgccctacccttctcctcgcacgtcctccacgaccaagtaactactaccagacncctactacacttaacgtcccgttacggtaccagaccgaacgaacgcccgtacggacccgacggtaccccttaccccggtacggtttccctacgtactttaccgttacgttcggtccggttccgggtaaccccacgggtaccgggccctacggtggcctacgtccagtaaccgtacggttacaggtcggacgtagggttcggtacggtacgggaactacgtaccttactactcgtactactctaagtcgaccgagtacgtcggacgtcgtagtactagttaccgntagttatacttgtctanacgtagtatgtacgttactccgttacctgttacggtcggacggtaccgaggtaaccgtagggtaactaacggtacgaacgttacgtcggtacgtcgtaccgtacctaccgttnttcgttaccg

SEQ ID NO: 146627 - DNA, 734 bp, Homo sapiens
  misc_feature: GYAE6OF02H7BPE.21.4.A04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccaccctgtctttgctcgagggaagngccaccctcnccngcagctccagccagaatcnccagancttaacacgatacgcctggtaccagcagaacgccgtggccgagtcctcccgtacggttccnctatctatgccgtcggtcccacgtacgggccacgtggaccacgtcccgaagacgtacggttacgaggtcggtacgtagggttggcgtagggaccgtaggtacccttcgtacctccttaccgtacgttacgtacggtttaacgtacgtaacgtaccggttaacgggacgtaccggttaacggtaacggtttacgttttaccgggacgttaagtttcgtttaatttaccgttggtacctacgggttacgtaaggttacgtttaacggggtaaagtttcccgtaccgtttacggtttcgggtacccgggtttaccggaacccggtaaacgggggttaaccggtaaaggggttaacgtaaaacggttaccggaaaacggttaaccggttaggtacgggtacgtacccgggttaccaaccgttacccgttacgttacccg

SEQ ID NO: 146628 - DNA, 634 bp, Homo sapiens
  misc_feature: GYAE6OF02H7DS8.21.4.A04.1.454.CMB.1.raw
  modified_base (216)..(216): a, c, t, g, unknown or other
  misc_feature (216)..(216): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (485)..(485): a, c, t, g, unknown or other
  misc_feature (485)..(485): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcagctggtggagtcgtgggggganacttggtccaggcctgggacgggtccctgagctctcctgtgcagcctcngcattcaccttcagtgaccaanaacatggactgggtccgccgaggcctccgaggggaacggggctagggaggtggggtcggacgtattacgaaggaacgactaacagttaacagtacaaggaactacggcgacgtcgtaggtaggaaaggtaaggttcaccatctacaaagtagatagtacttacaaaagtactacactgttaatctagaactaagtaanaacgaacgaccgtaacgaaaaccggtacggaaccggaaccgggtccggttagttacgtttaggtttagggttacgggtaaagtaaacgtaaaaaggttaggtacgggtagttagggttgggttaagggttcggtacgttgggtaaccgg

SEQ ID NO: 146629 - DNA, 765 bp, Homo sapiens
  misc_feature: GYAE6OF02GYBB8.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanagcccacctctccgtgcagcctccagacccaagtaactaactccgagacgtctaactacatacgccgttacggtaccaggcaacgaacggtcctcgggacccacgggtccctacccgtaacgggtttccctacgtacttccgttaagttccggtccggttacccgggtaccccgaacggtaaccggggtaccctaaccggttggacccgtaccgttaccccgaaacggtaaccgttacgggtttaccgaacggggttcgggtaccggtaggggttaccggggttaccggcggggtaaactaacgggttaccctttaacctaccgttccgttactactaccgttaacgttacgacgtaacgtacggtacggagtaccgtaagtaacgtacgtttcgacttaggtactttagttacgtgtacgagtcgaaagttagtacggtaaccgttcgccgttacgtcggttaccggttaccggaaccgtaacgggaaccgttaagggtaacgtaagtaacggtaaacgtacgttggacggtacttacggacttaaccgtgttacggttccg

SEQ ID NO: 146630 - DNA, 581 bp, Homo sapiens
  misc_feature: GYAE6OF02FRBBW.21.4.A04.1.454.CMB.1.raw
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacttggtccagcctggagggtccctgagactctcctgtgcagcctctgcattcaccttcagtcgaccacaacatagggacttgggtccgaccgaggcctccgaaggggaagggggctgggaggtggggtcggccgtattacgaaggaaagctaaacagttacagtacagaatacggcgcgtctgagaaacggagttacactatctacaagagatgtatacgaaagtaactcaactgtatctagacgtaaatagaactagacctagaaaaccgagaaccgacggacgtagtattagttaggtaggtaagtaacgtaaaaggtacgtagggtaacgtgggtagggtaggtacggtcgtggtaacg

SEQ ID NO: 146631 - DNA, 681 bp, Homo sapiens
  misc_feature: GYAE6OF02G65N5.21.4.A04.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaagcgccaccctctcctgcagctccacgccaagaatactccagacgcctaactacatacgcctaggtaaccagccaagaacgcctggccaggcctcccgagttccnactctagtcgcgtcgggtacccacggtacgggccacgtcggcactccagactaggttcacggtgacgtaggtcggtacgtacgggactacgtacgttcacgttcacgtactactagttacgactacggtacgtaggtacgtacgtaagtaacgtacgtttacgacttacggttacgttacgttacgttacggtacgtaacgtacgtacggttacgtacggttaaacgttccgtaaccgtttcggtttacggttaccggttaccgggaacccggtaacgggtaaccggtaaacgggtaaacgtaaacggttaacggtaaaaccggtaccgttagggtacggtccgtaacgtaacccgtaccgttacgttcccgttacgg

SEQ ID NO: 146632 - DNA, 707 bp, Homo sapiens
  misc_feature: GYAE6OF02IR2DJ.21.4.A04.1.454.CMB.1.raw
  modified_base (349)..(349): a, c, t, g, unknown or other
  misc_feature (349)..(349): n is a, c, g, or t
  modified_base (479)..(479): a, c, t, g, unknown or other
  misc_feature (479)..(479): n is a, c, g, or t
tcagtcgtcgctcgcacgaccggtgctcgatttagagtagtgatcagggggagagctgctcagttaggacccagagggaaccatcggaaacccagcgcagcttctcttcctctgctactctggcctcccaggctcagaaacccacggagaaattgtgtgacgcagtcctccaggcctccctgttctttgtctccgaaggggaaagcgaccctacctctccgtgcacgtcctaccgagaccgaagtaatacgtccgaagacgtactaactacgaagtacgaccgtacggtaaccacgacaaggtaacgcccgtagggaccccgtaggtccccttaccgtacggtttcccncctaacttacgtaacgttcgaccggttccgtaccccgaaggaccgggtacctaacgtcggacctactacccgagtaccgtaaggtccgtaggtcgacgtggtcgggtcgaggacagttacctcacgttcncttataccgtaagttacgaccgtagtaaccgtaggtaaccgtacgttaaggaacgttacgttacggtaccgttagtactttaacgttacgtcgtaccgtagaacgttaataacgtcggtaagttcccacgttccgttagtcccgtagaaccggacgaacgtaagggtaaactaacgtaaccggaagtaacgtaggtgtaccgtacgtcgaaccttacgttccgttacg

SEQ ID NO: 146633 - DNA, 645 bp, Homo sapiens
  misc_feature: GYAE6OF02F2E93.21.4.A04.1.454.CMB.1.raw
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
tcagtcgtcgctcgcacgaccggtgctcgatttagagtagtgatcagggggagctctgagagcggagcccccagcccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctgggacgggtccctgacgactctcctgtgcagcctcgtgcctattccaccttcagtcgaacccacaacatggacgtgggtccgccgaggccgtacggggaagggctgggagtgggtcggccgtataacgaaggaaacgctaacgagtacagtacaagaacacggngctctaggtagaaaggtagttcaacgtatctanaagagtatagtattaacgaaaagtacctacgacttagtaatcctagtaacaaagttacggaacgacgtacccgtaaacggaaaacccggaacggaacccgtaaacgggtccgtaagtttaatttacgttaggtaagggtaaacgaaacggtaaaaaggtcgggttaaggtaagttgggtacgggttaggttaggtaccggttaggtacgtaacgg

SEQ ID NO: 146634 - DNA, 799 bp, Homo sapiens
  misc_feature: GYAE6OF02FUFTM.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccgaggccaccctgtcttttgtcctaccgaaggggaaagacgcccaccctctcctgccagcctaccagacccaagtaaacctacccgagacgaccttaacctaactaactacggcccttacggtaacccagaccgaaacggaacgcccgtacggccccgaacggcccttaccccgtacggtttcccctacgtacttcctaagtcgtccggttaccgggtaccccaggaccgggcccaacggtcggaccctaccgtaccccgaaggtaaccgtacggttacgagggtcggacgtacgggttcgggtccgtagggaacctacggtaccttccgacctttccgactagtacgttaacgttacgactaacggacgtacgggacgtaccgtaagtaacgtacgttacgacgttaagttacgtttaacgttaccgttagtacctaagtacgttaaggttaacgttacgggtaacctttacccgtaaccgtttcgttacgggttaccggttaacccgggaaccggtaaacgggtaccgtaaagggtaaacggtaaaacggtaaccggtaaaaccggttacggttacggtacgggtacttaccgaacccgtaacctagttcccgttacgtttacccg

SEQ ID NO: 146635 - DNA, 662 bp, Homo sapiens
  misc_feature: GYAE6OF02GM376.21.4.A04.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaanacgcccaccctctcctgccagcctccagccagaatactccagacgctaactacatacgcctacggtaccagcaagaacgcctggcccaggcctccccgaggttcccanactctatcggcgtcgggtccccaagcgggccacgtgcactacccgagacgtaggttcaggtcggcgtagggtgggtcgagggactacgtaccttcgactcctacactctatgacgtagtacgtacggacgtctagtagtacttacggactaggttattagttactgtactgtatacggttagtacgttaacgttcctaaccgtttcgttacggttaccggttccgggaacccgtaacgggtaaccggtaaacgggttaaacggtaaaacgttaacgggtaaaaaccgttacggtaagggttacggtaacccggttaccgtaacccggtaaccgttaccgtttccgttaaccgg

SEQ ID NO: 146636 - DNA, 621 bp, Homo sapiens
  misc_feature: GYAE6OF02FNMDM.21.4.A04.1.454.CMB.1.raw
  modified_base (200)..(200): a, c, t, g, unknown or other
  misc_feature (200)..(200): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaanagccacctctcctgcagctccagcccagaactatccagagctactacatacgcctggaccagcaagaagcctggccaggcctaccccgaggtttccctacattcctaatcgccttggggaccccagacggcccacgtcggcactcccaagcctaggttcaggtcggcagggttcggtcagggacncgtacttcacttcgnatcagttagcgacgacgtggacgaccgttagaacgtagtttaccgacgtagttacgttagttacgtgtacagtacgaaggtttcgtacggttaacgtaccgttaccgttcgttagttcccgttacgggaccgtagggtaacccgtaagggttaacgtaaaagtacggtaaaacgtaacggttggttacggtacgttacgaccgtaccgtacgttccttacg

SEQ ID NO: 146637 - DNA, 700 bp, Homo sapiens
  misc_feature: GYAE6OF02HYQWA.21.4.A04.1.454.CMB.1.raw
  modified_base (148)..(148): a, c, t, g, unknown or other
  misc_feature (148)..(148): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctccaggctcagaaaccaccgganaaattgtgttgacgcagtcctccaggccaccctgtcgtttgtcctccgaaggggaaagacgaccctaccctctccgtgcacgcctcccaagcctaagtaactaacttccgaagtacgtacctaacaaccgtaagtacgcctacggtaaccaggacaaggtaacgcccgttacgggaccctagggtccctaccccgtagggttttacccaccgtacttacgttacgtcggtccgttaccggggtaccccacggaaccggggcctacggcgggtaccaacgtcccaaggtacgtacggttccgtaggtcggtacggtaacggttcgggttaccgtaaggggaccctaggttaacctcgaccttctcgactacgtacgttacgacgtagaccgtagaccgtacgtgaagtctacggtctaggttctatacgtcgtacgatacgtagtagtaggtactacctacgtctggttaccgtacgaacctagggaacttaagggaagaacgttaagaacgtaacgtcggtacgtcgacctaacggtactcgtagttaccgg

SEQ ID NO: 146638 - DNA, 716 bp, Homo sapiens
  misc_feature: GYAE6OF02GIPIH.21.4.A04.1.454.CMB.1.raw
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcagctggtggagtcgtgggggagacgttggtccagccgtgggacggtccctgagactctcctgtgcagcctcgtgctacttccgtaacctttcacgtcgaaccaaccaaacgagtacgggaccgtcggggtcccgaccgacgggtcccgtaccggaagggggaacgggggtctacggggagggttcggggtcccggtaccgttaagttaacggaaaggtaaacgtacgtaaacgtacgtttaacaaggttaacgaagtaaacgtaccgggacgtaccggtgttaggtaaacgggtaaaagggtaccggttacccgaaccttaagttacccgtaaacggaaaagtaccggtaattacggtaatttaaccaaaacggttactacctacgttagtaacttcgacgactaaagtgaaacgtacgtaccgtaaacggaaaccgagaccggacgtacgtattacgttatagggttaacgaagtaaacgtaaggtacgtagacgttggtaagggtggtagtcggtagtacg

SEQ ID NO: 146639 - DNA, 780 bp, Homo sapiens
  misc_feature: GYAE6OF02HKY7I.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggtcaccctgtctttgtctcgaggggaancgccgaccctctcctgcgagctccgacgccagtaagtactccgagacgtcctactacagtacgccttacgggttaccaggcaaggaacgtccgtacgggccgaacggtccttaccccgacgggtttccctcgtaacgttcctaacgttcggaccggtttcgggtacccccgaacggaccggggtccctaacggtgggaccctaaccgttcccgaacggtaacgtacggttacgaggttcgggaccgtagggttacgggtacgtacggggtaaccagttacccgtttcgaccgtttcgtacgtacgtacgtagttaccgacgtacgtacgtaggacgtaccgtaaggtaacgttacgtttaccgacgttaggttacgttaacgttacgtaccgtacgtaagtacggttaacggtttaggttaccggtaacggtttccctaaccgttccgggttttacgtaccgggttacccggtaacgtaaccggggtaactaacggggtaaagtacggtaaacgggtaaacccgttaggtaccgggttacaccggttacgaacccgtaacgttaccgttaccttaccggg

SEQ ID NO: 146640 - DNA, 739 bp, Homo sapiens
  misc_feature: GYAE6OF02IWTZA.21.4.A04.1.454.CMB.1.raw
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagcgccaccctctcctgcagctccagccagaatntccagacgctactacatacgcctaggtaccagcagaacgcctaggccgaggcctcccgaggtttcccnctacttctagtcggccgttcggggtccccaggacggggcccacggttgggacctacgtccccgaaggaccgtacgggtttccgaagggttccgggacgtaagggtttcggggtaccgtacgggggaaacctacggttacccgtttccaaccgtttccgttactaacgtttccgtaagtttaacggaccgttaacgggtaaccgttcgggaaccgtacccggttaaggtaaaccggttacgttttaccggaaccgttagggtttacgtttaacgttttaccgtcgtaacgtacgtacgttaaggttacgttacgggtaacgtttcccgtaaccgtttcggttacgttaccgggttacggaacccggtacgggtaaccgtaaggtaacgtaagtacggaaacgtacgtggtacgtacgtacgacctacgtactcgttacg

SEQ ID NO: 146641 - DNA, 919 bp, Homo sapiens
  misc_feature: GYAE6OF02IVAYM.21.4.A04.1.454.CMB.1.raw
  modified_base (914)..(914): a, c, t, g, unknown or other
  misc_feature (914)..(914): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcctgacgctacgaaccgaaaccgacggaagttaaagtttggttaggtacggaccgacgtacgttccgtaccggacggacccctacccgttcggtttttctttttcgtacccgtaccggggaaaggggaaacggtaccgaccccttacccttcctaccgtcgacggaccgtccctccgaccgaccgtaaacgtaaacttaccgacccgaaggtacgtaacccttaacgtaaacctaacgtacgtaccccggtttaaccggaaaccgaacgaccgtaaaacggaacccggtcccggtaccgggaacccggtaccgggtaccccgttaaccccggttacccggttttaccctaaccggtacttttaaccgttacgttaccggttacccgggttacccgggtaaccccaaacggggttaccccgggtaacctcgggttaccgaccttaacccgtacccggaacgttaccgggtttaagttaccggaagggtccgtaagggttaggttacggggttcgaacggggtactaacgttacccgttactacgttcctaacgtacgttacgtacgttaacgaacggtaacgttacggacgtacgtacgtaacggtaactttacgttacgacgttagttagttactttacgtgtacgagtacgtagttacgttaacggtttactttaccggttcgttaccggttaccgggtacgtaaccggtaacggtaacgtaacggtaaagtaacggtaaaggtaaccgtacggttaggtacggtacgtaacgacctactaccggttnttacg

SEQ ID NO: 146642 - DNA, 588 bp, Homo sapiens
  misc_feature: GYAE6OF02GHVUA.21.4.A04.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctccccaggctcagaaaccaccggagaaattggtgttgacgcagtctccaggcaccctgtctttgctccgaggggaaanagccaccctctcctgcagctccagccagaatatccaaganctactacatagcctggtaccagcaggaagcctggccaggcctcccgaggttcctcatctagtgcgtcgggtcccacgcgggccagtcggcacgtcccgagaccaggttcagtcggctaggtcgggtcgtagggacaggtaccttacgactcctacattctattacgactagacgtaggacgaccgtagaagtacttacgctagtacttagttacgtgtacagtacgagtagtaggtacgttctaccgttcgttacgtcggttccgaccgtaacgggaaccgtaaggtaacaaaggtacgaaaccggtagtaggtacgtcgtacgacctaacgtacgtagttaccg

SEQ ID NO: 146643 - DNA, 798 bp, Homo sapiens
  misc_feature: GYAE6OF02HSKKA.21.4.A04.1.454.CMB.1.raw
  modified_base (209)..(209): a, c, t, g, unknown or other
  misc_feature (209)..(209): n is a, c, g, or t
  modified_base (344)..(344): a, c, t, g, unknown or other
  misc_feature (344)..(344): n is a, c, g, or t
tcagtcgtcgctcgcacgaccggtgctcgatttagagtagtgatcaggggagagctgctcagttaggacccagagggaaccatggaaaccccagcgcagcttctccttcctcctgctactctggctcccaggctcaagaaacccaccggagaaattgtgttgacgcagtctccaggccaccctgtcctttgtcctccgaaggggaaacncgccaacccctcgtcctggccagcctccgagcctaagaaatacctacccaagacgacctaactacctaagaacgtcctcggtaaccaagcaaggaaccgccgtggcccgtaggctccccgtaacggtttcccctnaactccttaagtcggtaccgtaccggtcccaacggacgggtccctaacgtcgggacctaaccgtcccaaaggccgttaaacgggttcgtacggggttcggaccgtggggtttcggggtccgtaaccggggtacgtaacggttacctttaacccgtaccttcgttcccttaaagtcttaacgtacgtaacaggtaccggtagtacgtactaaggaacgttattccgggattaggtacgtttacgttaaccgttgttaccgacgttagtaagttggtaaacggttactttacccgtaaacccgtttggttcccggttaccggtttacccggggaacggtaaccgggtaacccgtttaaaagggtaacgaaaacgttaaccgggtaaaccggttaaccggtggtttaaccgggccttaacgggacccgtttaaccccgtagttttaacccccgttgg

SEQ ID NO: 146644 - DNA, 885 bp, Homo sapiens
  misc_feature: GYAE6OF02HGEFD.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaaanacgccaccctctcctgccagcctccagccaagtaaactactccgaagacgtacctaactaacagtacgccgttaggtaccagacaagaacgtcctcggaccgacggtcctacccgtacggtttcccactacgttcctagtcggtccgtaccgggtaccccaacggacgggtacccacgttcggacctaccgtacccgaaggtaccgtacgggttaccaaggttcggacgtacgggttcgggtacgtacggggtactaacgtactccgtaacgtctactactcgtacgttacgacgtaacggtacgtacggtacgtacggtaacggtaacgttacgtttaccggaacgtttaggttaacgtttaacgtttaccgttacggtaccgtaacggtaacggtttaacggtttaaccggtaccgggtttaaacccgtttacccgtttaaacccggtttccggttttaccgggtttaacccgggtttaaccccgggggtaacccgggttaaaccgggggtaaaacccgggtttaaaacggggtaaaaccggtttaaaaaccgggtaaacccgggttaaaaaaccccggggtttaccgggtttaaccggggtttacccggggtaaccccgtttaacccgggtaaaccccggtttaaccccggtttaaccggtttaacccggttttaccccggg

SEQ ID NO: 146645 - DNA, 651 bp, Homo sapiens
  misc_feature: GYAE6OF02F20GH.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcaggggaaangccacctctcctgcagctccagccagaatatccagagctactacatagcctggtaccagcagaagcctggccaggctcccaggttcctcatctatcgctcgggtcccagacggggccacgtggcactcccagacaggttcaggtggctaggtcgggtcgtgggacagtaccttcacttccgtcattccagttacgctaaggtactgggtacgtcccgtaggtaacgtagttttaccgctaacggttgttaactttacgttcgtacagtaccgtaggttaacgtacgggtaaacgtttccaacccgtttcgttacggttaccgggtttacccgggaccgtaaaggggaacccgtaaagggttaaacggtaaaacgtacgggtaaaaaccggttaaccgttaggttaaccgggtccttaacgggaccctaacccgttacgttaccgttaaccgg

SEQ ID NO: 146646 - DNA, 652 bp, Homo sapiens
  misc_feature: GYAE6OF02GE29T.21.4.A04.1.454.CMB.1.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (470)..(470): a, c, t, g, unknown or other
  misc_feature (470)..(470): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggggagacgttggtccagcctgggacgggtccctgacgtactctcctgtgcagcctctgcattcaccttcagtgaccacaacntggactgggtccncgaggcctccgaggggagggctggaggtgggcggcgtatacgaaggaagctaacgagttacagtaacagaatacggcgcgtactgagaaaggagttacactatcgtacaaggactagtagtaattacgaaaacgactctaagtcgtaatcctagaacgtaaanacggtaaaccacgtacccgtaaacggaaaaacccgggtggaaacccgtaaccggggtacccgttaagtttaacgttacggtttacggggttaaggtaacggtaaaaccggttaaaaaggacggggtttagggaaggtttcgggttaggggttacgggtaacggttccggttaggttaaccgg

SEQ ID NO: 146647 - DNA, 727 bp, Homo sapiens
  misc_feature: GYAE6OF02IU647.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaanagccaccctctcctgcagctccagccagaaatactccaagacgctaactacatacgccgttggtaccagcaaggaacgcctggaccaggccctaccccgtaacgggtttccctacgacttcctagtcggaccgtcggggtaccccaacggacggggacccaccgttggacctacgtaccccgaagtaacgacgggtttcaagggttcgggaccgtagggttcggggttacgtacggggaactacggtacctttccgaacctttccgtactaacgttaccgtaagtttaacgacgtaacggtacgtagggtacgtaccgttagaaacggtacgttttcgacgtagttacgttaacgttacgtcgtacgtacgtacgtagttacgtacggtaacgtttcctaccgtttcgttcggttaccggttaccgggtaaccgtaacggggtaaccgtaaagggttaaacgtaaaagtaacgggtaaaacgtacggttaggtacggtcgtacgacgtaaccgtacgttacgttcg

SEQ ID NO: 146648 - DNA, 611 bp, Homo sapiens
  misc_feature: GYAE6OF02FLMJC.21.4.A04.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangcccacccttctcctgcagctccagccagaactatccagagctaactacatacgcctggtaccagcaagaacgcctaggccaaggcctcccgaggttcccncatctagtcgcgtcgggtcccaagacgggccacgtggccacgtcccagacctaggttcacggtggccgtagggtcgggtacgtggggaacaggtaccttcgacttctcgtatctagtacgacaagtaccgtggaacgtcgttaggaaattagtttccggntaaggtttcgtaactttacgtcgtacagtcgtaaggtacgtaggtacgttaccgtacctgttacggttccgtacggaccgaagggaccgtaaaggtaacgaacgttaacggaaacgtacgtaggtaggctcggactaccgtatcgttac

SEQ ID NO: 146649 - DNA, 687 bp, Homo sapiens
  misc_feature: GYAE6OF02IWSJC.21.4.A04.1.454.CMB.1.raw
  modified_base (575)..(575): a, c, t, g, unknown or other
  misc_feature (575)..(575): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgggagtttgggctgagctgggttttccttgttgttattttacaaggtgtccagtgtgaggtgcagctggtggagtcgtgggggagacgttggtcccagccgtgggacgggtccctgagacctctcctgtcgcagtcctctgctacttccaaccttcgagtcgaccaacaactatcggtactcgggtccgccgaggcctaccggaaggggaacggggcgtaggggtaggttcggggtcggtacccggttaagtttaacgaaacggtaaaacgacttaaaacgagtttaacgaacggttaacgaaagtaaacgttaaccgggccggttacggtaccgtaggtaacgggaaaagggttacgggttacccaaccgtattaccgtaacgaaagggtaagtactaaggtaaacgttacgaaaaacggtacctacgaccttaggttaacnccgttagacctaaaagtcgaaacagtaaccgtaacgaaaaccgacgacgaacggtcttagttattagttcggagtaactaagaagtgtaggagtgtggtagacgtcgtgtac

SEQ ID NO: 146650 - DNA, 819 bp, Homo sapiens
  misc_feature: GYAE6OF02JZH2B.21.4.A04.1.454.CMB.1.raw
  modified_base (197)..(197): a, c, t, g, unknown or other
  misc_feature (197)..(197): n is a, c, g, or t
  modified_base (784)..(784): a, c, t, g, unknown or other
  misc_feature (784)..(784): n is a, c, g, or t
  modified_base (809)..(809): a, c, t, g, unknown or other
  misc_feature (809)..(809): n is a, c, g, or t
tcagtcgtcgctcgcacgaccggtgctcgatttagagtagtgatcaggggagagctgctcagttaggacccagaggaaccatggaaaccccagcgcagcttctcttcctcctgctactctggctccaggctcagaaccaccggagaaattgtgttgacgcagtctccaggcaccctgtcttgtctccgaggggaaangccaccctctcctgcagctcagccagaatactccagagctactacatacgcctggtaaccagcaggaacgcccgtagggaccccagggtccctccccgtaacgggttccctaccgattccgttaagtcggtacggtttaccggggtccccccaacgggaacgggggcccctaaaccggttcggggacccctaacggttacccccgaaggtaaacccgggttaccgggtttaccaacgggggtttcgggtaccgaaggggttttacccggggttacggtacggggggaaacccttaacgggttaccccgttttaccggaaactttcccccggttaataacggtttcctaacggtttaaccgggacgtaaccggtaaccgggttagggtaaaccgtccccgggttaaggaaacgtttccgtttaccggaacggttacggttaacggtttaacgtttaccgttaggttaccgaaggttaacggtaattacgggttaaacgggtaccgtttacctaaccgttgtttacggtcccggttaacggtaccgaacggggtacgtaacggtaagtaaaccgtagaaaccggttacngggtaccgtcgtagacctaccggtnttcgttaccg

SEQ ID NO: 146651 - DNA, 651 bp, Homo sapiens
  misc_feature: GYAE6OF02GL5WY.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagccaccctctcctgcacgcctccagccaagaatactccgagacgcctaactacagtacgcctcggtaccagcaagaacgcctggcccaggcctcccgaggttcctcatctagtcgcgtcgggtcccacgacggggccacgtggccacgtcccgaggaccgtacggttccaggtcggacgtagggttcgggtcgtcgggaacaggttaccttccggaccttcgtactacgtactagttaacgacgaacgtacggtaggtacgtaccgtaggaacgttacgtttcgacgtacgttacgttacttacgtcgtacgacgtcgaagttagtacggtaagttccgtaccttcgtacgttcggttaccggaccggaagggtaccgtaaagggtaacgtaaacgtaaggaaaccgttaacggtgtacggtacgtacggtaccacgtacttcgttacg

SEQ ID NO: 146652 - DNA, 566 bp, Homo sapiens
  misc_feature: GYAE6OF02F9YMZ.21.4.A04.1.454.CMB.1.raw
  modified_base (438)..(438): a, c, t, g, unknown or other
  misc_feature (438)..(438): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttgggtccagccgtggagggtcccctgagactctcctgtgcagcctctgcattccaccttcagtcgaccacaacatggactgggtcccgccgaggcctccgaggggaaggggctggaggtgggtcgccgtattacgaaggaagctaacagttacagtacagaatacggcgcgtctgtagaaaggtagttccactatctagaagagatgattacaaagtacncactgtatcgagacaaatcgaactacgacctaaggaaaaccgacgaccgacggtaccgtagttattacgttaggtaggtaacaaacgaaagtagttaggagttgggtggtaggtacgtcgtagtacgg

SEQ ID NO: 146653 - DNA, 897 bp, Homo sapiens
  misc_feature: GYAE6OF02GB4H2.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaanacgccacctctcctgcagcctccagcccaagaactactaccgagacgaccttacctaacaagtacgcccgttacggtaacccaggaccgaacggaaacgtccccgttacgggaccccggaacgggtccccttacccccggtaacggggtttttaccccctaccgtaacgtttaccgttaacgttccgggtacccggttccgggggtaccccccaaccgggaaccggggggtacccctaacggttcgggacccctaaccgttacccccgaaagggaacccgtaacgggtttaccgaacggggttacgggaccggtaaggggtttccggggttacggtacggggaacctaacggtaacccgtttaccgaaccctttccgtactacgtacgttaacgtttaacggaaccgtaacggtaaccggttacgggtaacgtacccggttaaggtaaacggttacgttttaccggaacgttaacggtttaacgtttactttaaccggtacgtaccgtaacggtacgttaacggttaggttacggttaaacggtttacccttaccgttaccggttaccggtttacccgggttcccgggtaaccgggtaacggggtaaccggtaaggggtaaacgtaaacggtaaccgggtaaaacgtacggttagggtacggtacggtacggtacccgtacgtacgttcgttaccgg

SEQ ID NO: 146654 - DNA, 881 bp, Homo sapiens
  misc_feature: GYAE6OF02HXHDZ.21.4.A04.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacgaaggtgtccagtgtgaggtgcagcgtgggtggaggtcgtgggggagtacgttggtccagccgtgggacgggtcctgacgacctctcctgtgcncgccttctgactactttaccacctttcgacgtaccgaacccaaccaaactagtacgggtaccggttaccggggtcccgaccgtacgggcccgttaccgggaacggggggtaacgggggtcggttagggggacggggttcggggggtaccccgggttaccggttaacggttaaaccggaaaaagggtaaaccggtaccttaaaaccgtaacggtttaaaccaaacggttaaccgaaaacggtaaacgtaaccggggtacccggttacggttaccggttagggtaaacgggtaaaacgggggtttaaccgtttccccaaaccgttaactttaccggtaaacggaaaacggtagtaacgttaacggtaaacctttaaaccgaaaaacgttaacccttcgtaaaccgtttaggttaacctccggtaagtaaactaaaaccgttacgggaaacctaaccggaccgtaaaaccgggaaaaacccggacgggtaaaccgtccggggttaaccgtttcggttaagttttacggtagggtaacggttaaaacgaaacgggtaaaggtacgggttagggtaggttacggttaggggtttaaggtaccgttggttacggtaacg

SEQ ID NO: 146655 - DNA, 566 bp, Homo sapiens
  misc_feature: GYAE6OF02FP78K.21.4.A04.1.454.CMB.1.raw
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagtcgtcgctcgcacgaccggtgctcgatttagagtagtgatcaggggagagctgctcagttaggacccagagggaaccatcggaaaccccagcgcagcttctcttcctctgctactctggctcccaggctcagaaaccaccggagaaattgtgttgacgcagtcnccaggcaccctgtctttgctaccgaggggaaangccacctntcctgccagcctccagcctagaatatccgagagtcctaactacattacgcctggtaccagcagagcctgcaggctccagttcctcatcatgctacgggtccagaggcctacgtggcactcccagaccaagttcgagtggcaggtgggtctgggacagacttcgactcncatcatancagactggacnccgtagaacgtagtttcgacgacgttagttattacgttgtacagcgagttataggtaacgttacctaccgtcgttcgtcggtttaccggaccgtaaggaaccgtaagggtaacgaaagtacggtaaaacgtacgttacggtacggacgttcggactacctacttcgttcg

SEQ ID NO: 146656 - DNA, 740 bp, Homo sapiens
  misc_feature: GYAE6OF02IF55P.21.4.A04.1.454.CMB.1.raw
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagtcttgggttttccttgttgttattttacaaggtgtccagtgtgaggtgcagcgtggtggagtcggtgggggagtacgtttcggtccagcccgtgggacgggtcccctaggacgtaccttccgtccgtggtcgaccgacgtccccttcgtcgtcctactttcctaaccctttcgacggttacgaacccaacaactagtcggtaccgttcggggtcccgccgacggtccgtaccggaggggaacggggtcgtaggggaggtcggggtccggtaccgttaagtaacgaaaggaacgtactaaacgagttacagtaacgagtaacgtacggcgtcgtagtaggtaacgaaaggtacgttaccaaccgtattactacgaaaggtagtataggtaattaccgaaaagttactacacgttagtactcgtacgaactaaagtagaaccgtacgtaacccgtaacggaaaaccgacgggtaccgaaccgggttacgttaaggtttacctttagggttacgggttaacgtaaaaggtaaacgtaaaagggttcgtaaggggttacgtggggttaacgggttaggtaacggttcgtaggtaccgg

SEQ ID NO: 146657 - DNA, 691 bp, Homo sapiens
  misc_feature: GYAE6OF02G7K7D.21.4.A04.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccagaatntacccagacgcttaacacatacgcctggtaccagcaagacncctggccaggctcccgagttccncatctatgcctcgggtacccacggtacgggaccacggtggccactcccgagacgtaggttcagggttgccgtaggttcgggtcgtacggggaactacgtaccttcaccgttcctacgtacttcgtaacgttacggaccgtaaggtaccgtagggtaacgtcccggttaagtaacgggttacctttccggacgttaaggttactttaatttaccgggtgttaccggagttacgaaggtttaagtacgggttaactttccgtaccgtttacgttcggttacccggttaccggaacccgtaacgggacccgttaaaggggttaaacggtaacgtaaacgggaaaccgttacggttacgtacgggttactacggtaccctaaccgtacgttcgttacg

SEQ ID NO: 146658 - DNA, 634 bp, Homo sapiens
  misc_feature: GYAE6OF02HB4XH.21.4.A04.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcaggggaanagccacctctcctgcagctccagccagaatactccagacgctactacatacgcctaggtaccagcagaacgcctggccaggcctcccgaggttcccncgattctatcggctcgggtccccagcggggaccacgtcggacctacgtcccgagtacgtaggtttaccgaggttggaccgtagggtcgggttacgtcggggtaacaggttacccttccgaaccttccgtacgactcctaagtttacgacgtacggtaccgtaggacgtaccgtagaacgttcgttccgacgtagttagttacttacgtgtacgagtcgtaagtacgtaggtacgttcctacgttcgttacgttcgttaccggaccgtaacggtacgtaaggtaacgtaacgtacggtaaacgtacgttgtacggtcgtacgacctacgtacgttcgtacg

SEQ ID NO: 146659 - DNA, 806 bp, Homo sapiens
  misc_feature: GYAE6OF02I9LCS.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccacggagaaattgtgttgacgcagtctccaggcaccctgtctttgtctccgaggggaagcgccaccctctccgtgcagcctccagccaagaactactccgagacgtctaactacatacgccttaggtaacccagacaaggaacgcccgtaggccccgaagggtcccttccccggtaaggtttccctacgtaacgttccttaagttcgggccggttaccggggtccccaacgggtaccggggtacccctaacggttccgggtacctaccgttaccccgaaacggggtaccttacgggtttaccgaacggggttaccgggtcgttaaggggttccgggggttaccggttaacggggaaccgttaaggtacccgttttaccgtaacctttccgtaacttacgttcgttaaacgttacgtacgaacgtaccggtagggacctaccggtaaggtaaacggttccttcgaacggtttggttaacgttacttacgtcgttaagacgtacgtaagttaggtacgttaagttaccccgaacttttcggtaccggtttcggtacccggggtacccgtaaggggtaacctaaacggggtaaggtaaaaccgttaccgggaaaacgttacggttggttacggaccgttccgtaacgaccggttattacggttacccg

SEQ ID NO: 146660 - DNA, 892 bp, Homo sapiens
  misc_feature: GYAE6OF02GIIBQ.21.4.A04.1.454.CMB.1.raw
  modified_base (258)..(258): a, c, t, g, unknown or other
  misc_feature (258)..(258): n is a, c, g, or t
tcagtcgtcgctcgcacgaccggtgctcgatttagagtagtgatcaggggagagctgctcagttaggacccagagggaaccatggaaacccagcgcagcttctcttcctctgctactctggctccaggctcagaaaccacggagaaattgtgttgacgcagtctaccgaggcaccctgttctttgtcctacgaaggggaagacgccaccttcgtcctcggcacgcctccgacgaccaagaactacgtaccaaggtacnctttaaccatacttacggccgttaagggtaacccaggaccaaaggtaaaccgcccggttaggacccggaacggggtcccttaccccgtaacgggtttcccttaacgacgttaccgttacgtccgggtacgtacccggggttacccccaaggggaacccgggtcccgtaaacccgttacggggacctaaaccccgttcccccggaaaaacggtacgggtttaaaccgggttttccggaagggtttacccgggaaaccgttaacggggggttttcccggggggttactttaccgggggggaaaaacccttacccgggggttaaaaccctttttcccctaacgttttaacccggttagtaaaccgttaccgttaaacgtttaaccgtacgggttaaacggtaccggttaacgggtaaccggtaccgtacggaaaggttccgtttaacggacgttacgttacgttacgttacgtaccgttacgtacgtacgtaagttacgtacggttaacgttacctacgtcgttacggtccggtacgggtacccgtaacggaaccggtaaacggtaaaggtaacgtaaacggtaaacgtaacgttaacgggtcgtacggaaccgtactaaccggtatcgttaaccgg

SEQ ID NO: 146661 - DNA, 842 bp, Homo sapiens
  misc_feature: GYAE6OF02JUNM6.21.4.A04.1.454.CMB.1.raw
  modified_base (147)..(147): a, c, t, g, unknown or other
  misc_feature (147)..(147): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggctcccaggctcagaaaccaccgganaaattgtgttgacgcagtctccaggccaccctgttcttgtctcgaggggaagcgccaccctctctcgcagcctaccagacccgaagtaactactccgaagacgtcctaactactagtaaccgccgttacggtaaccaggtacgaacggtaaccgtcccgtacgggacccacgggtaccctttacccccggtacggttttacccctacttaacgttaaccggtttacgtcccggttacccgggttcccggggttacccccaaccggggtaccgggggtaccctaccgggtacggtaccctaaccttaccccgaaagggttacccggttacgggtttacgtaaccggggttcggaccggttaggggttttccggggacgttaccggggaacctaaacggttccgttccctaaccttccgttacgtaacttaccgtaagttacggacgtaacggtacgtacgggtactacggtaacgtaacgtttcgttaccgacggtttagttacgttacgttacgttacgtcggtaacgtaccgttaaggttacggtacggttaaccttacgttacccgttcgttacggttaccgggttaccggtaacccggtaacgggtaaccggtaagggtaaacgtaacgtaaggtaaacccgttaggtaggtacggtccgtaccggaacctaccggtacgttcgttacccgg

SEQ ID NO: 146662 - DNA, 769 bp, Homo sapiens
  misc_feature: GYAE6OF02HFHP0.21.4.A04.1.454.CMB.1.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggtttttccttgttgttattttacgaggtgtccagtgtgaggtgcagctggtggagtcgtgggggagacgttggtccagcccgtggacgggtccctgacgaccttctccgtgtgcagcctntgctattcaccttcngtcgaccaacgaacagtacggaccgtcgggtcccgccgaggcctaccggaaggggaacggggtctaggggaggttcgggggtaccggtaccggttaattaacggaaaacggtaaagtaccttaaacgtaggtttaaccgaagttaaccgaaggtaaacgttaccggggacgttaccggtaccggttaggtaacgggaaaacggggttaaccggtttcccaaacccggtaacttaccccgtaacgaaaggtacgtaagttacgtaaattaaccgaaaagtaaccgtactacgttagttactaccgtgaactaaagtacgaaacgacgtccgtaaacgggaaaacccgtggaaacccgtaccggggttaccttaaggttattttacggttaaggttaacgggtaaacgtaaaaccggtaaagggtaggttaacgggagtttcgggggtaggttaaccgggttagaccggtttaggtaacccgg

SEQ ID NO: 146663 - DNA, 782 bp, Homo sapiens
  misc_feature: GYAE6OF02HLGCQ.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtcagtgtgaggtgcagctggtggagtcgtgggggagtacgttggtccaggccgtgggacgggtccctgacgactctctgtgcacgcctctgctacttccaccttcagtcgaccactaacagtcggacgtcgggtcccgaccgaggcctaccggaggggaacggggcgtagggacggtcggggtccggtaccgttaagttaacgaaagggtaaacgacctaaacgtaggtttaacaagtaacgaaggtaaacgtaccgggcgtaccgttcgtagggtaaggtaaaacgggtacgttcccaacctagtaccgtaacgaaaggtacgaattacggtaactttaacgaaaacgtaaccttactaacgtttagtaactacggtacgaacgtaaaaggttcgaaaaccgtacggtaacccgtaaacgggaaaaaccccgggtaaggaaaccccggtaaccgggttacccgttaaggtttacgtttttaaacgggtttacggggtttaacggggtaaaacgtaaaaccggtaaaaaagggttaggggtttaacggtagggtttccggggttaagggggtttacgggtaacggttcggttacggtaaccgg

SEQ ID NO: 146664 - DNA, 798 bp, Homo sapiens
  misc_feature: GYAE6OF02H09SH.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgagcctacctgttcttcgtctaccggaaggggaaacgaccgaccctaccctctccgtcgacgacgtcctaccgacgaccgaagtaactacctaccgaaggacgtaccttaacctaactagtacgtccgttacggtaccacgacgaaggaacgccgtacggaccgacggtccctaccggtacggttccctacgtactacttagtcgtccggttaccggtacccacggaccgggacctacgtcggacctaccgtacccgaacgaccggttacggttacgacgggtacggacgtacgggttcggtcggtacgggacgtacgttaccttaccgaccttcgtactacgtaactagttaacgcgtaacgtacggtacggacttaccggtaaggtactttacgttcgacggttagttacgttaacttcgtacgaacgtacgtaacgttaaggttacggtacggttaaccttacccgtaccgttcgggttaccggttcccggggttaacccgaaccgggttaaaccgggggactttaaaacggggtaaacgttaaacggtaacccgggtaaaacgtttacggttcgggtacgtaccggttaaccgaaccccgttaagttccggttcccgttaacgg

SEQ ID NO: 146665 - DNA, 778 bp, Homo sapiens
  misc_feature: GYAE6OF02GNVNA.21.4.A04.1.454.CMB.1.raw
  modified_base (198)..(198): a, c, t, g, unknown or other
  misc_feature (198)..(198): n is a, c, g, or t
  modified_base (570)..(570): a, c, t, g, unknown or other
  misc_feature (570)..(570): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctacacgaaccaccggagaaacttgtgttcgacgcagtctcagcacctgtcttgctccgagggaaacncgcccacctcgtcctcgcacgtctaccgacgccaagaactacgtaccgagacgcttaaccgtaacacgttaccggtacccgttacgggttaacccaggaccaaaggtaaccgcccgttacgggaccccgtaacgggccccttaccccgtaacgggtttttcctaaccgtaagttccccgtttaagccccgggtttacgttacccgggggaccccttaaggaacccgggggtccctaaccgggggtcgtaacctacccgttaccccgaaaggtccggtttaaacggttcccgaaaggggtttcgaccggtaacgggtttcggggtaccggtagggtaaccctaggttacccttaccggtaccctttaacccgngttaacctaccttaaggttaccgtacgtacggtaacgttcgggcgtacgttaacggtacgtacggtttaccgacggtaagtttcgtaacttttcgagttcagtactagtagtaccgtagttaccgttacgttcggtcgtccgacggtacggaacttagggaacgaagttaacgaacgtcgttaggacttcgacgcgaccttgtactcg

SEQ ID NO: 146666 - DNA, 741 bp, Homo sapiens
  misc_feature: GYAE6OF02G97FG.21.4.A04.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (291)..(291): a, c, t, g, unknown or other
  misc_feature (291)..(291): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaangccacctntcctgcagctccagccagatactccagagctactacatagcctggtaccagcagaacgcctggccaggcctacccaggttcccanactctagtcgcgtcgggtcccagcgggccactcggcactacccgaagtacgaggtttaccaggttcggcgtaggttcggggttctaggggaacctaacggtacctttaccgaaccgttcgtaccgtaacgttacctaacgtttacgaccgttaaggtaccgttacgggtacgtaccgttacggtaaacgtacgtttacgacgttaacggtttcgttaagtttaccgtcggttacctaaggtaccttaaggttacgttaaggggttaaaccgtttaccgttaaccgtttcggttaccggttaccgggtttaccggacccgggttaacggggaaacccgtttaaggggtaaacggttaaaaacgttacgggaaaaaccgttaacggtttaccgggttacgggtacccgttaaccgggtacccgtaaacccgttacgttacccgtttaaccgg

SEQ ID NO: 146667 - DNA, 894 bp, Homo sapiens
  misc_feature: GYAE6OF02HQZAD.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctgctcccaggctcagaaaccaccggagaaattgtgttgacgcagtctccaggcacctgtctttgctccaggggaagacgccaccctctcctgcacgcctccaggccagaaactactaccgagacgacctaacgtacagtacgccgttaggtaaccagactaagaacggccctggcccaagggtcctaccccgacgggtttccctacgaacttactaagttcggaccgttccgggggtaccccctacggaacgggggtacccctaccggttcgggacctaaccgttccccggaacgtaccgtaacgggttttccggaacgggtttcgggaaccgtaggggtttacggggttaccggttacgggggtaaacccttaaccgggttacccgttttaaccgtaacccgttttaccgttaacccgtacgtttaaccgtaacggtttttaaaccggaaccggtaaacgggtaccggttacggggtaaacgtacccgttaagggtaaaacggtttacgttaaccggttacgttaacggttacggttttaaacgttaccgggtttacgttaccggtaacgttaaccgttaaggtttaagttaccgggttaacgtttacccgttaaccgtttacgttacgggtttcccggttaacggggtaacccggtacggggtaaacccggtaaaggttaaaacggggttaaagtaaccgggtaaaccggttaacggttaggtaccggttacgcggttaacccgtaaccgttaccgttaccgttttaaccgg

SEQ ID NO: 146668 - DNA, 754 bp, Homo sapiens
  misc_feature: GYAE6OF02IYH62.21.4.A04.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagaaattgtgttgacgcagtctcaggcacctgtctttgctcgaggggtaangccacctctcctgcagcctccagccagaatactccgagacgctactacattacgcctggtaccagacagaacgccgtcggccaggcctcccgaggttcccngattctagtcgcgtcggtacccacgcgggcccacgttggacctactcccgaagtaccgtaggttccgaggtcggacgtagggtttcggggactaggggaaccaggttacccttcgaccttctacctattaccgtaagttacgccgtaaacggtaccgtacggacgtacccgttaggtaaagttaccgttttaccggacgttaacggtttacgttaacgtttaccgttaggttaccgaacgttaccggttaaagtttaccgttaagggtaaccgttttacccgaaccgtttcgttacgggtttccccggttaaccgggtaacccggtaaccggggttaacccgttaaacggggttaaagtaaaccggttaaaccgggtaaaacgttacccggttaggtttaccgggaacccgtttaccgggaaaccccttaaccgggttaccttacggtttaacccgg

SEQ ID NO: 146669 - DNA, 684 bp, Homo sapiens
  misc_feature: GYAE6OF02JSIG4.21.4.A04.1.454.CMB.1.raw
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagcttgggttttcttgttgttatttacaaggtgtccagtgtgaggtgcagctggtggagtcgtggggagacgttggtccagccgtggacggtccctgacgactctccgtgtcgcacgcctctgctacttctaccttcgacgtcgaaccacaaacgtagtacggtacgtcgggtccgaccgacggccgtaccggaaggggtacggggcgtaggggtaaggtcggggtccggtaccggttataaacggaaggtaaacgacctaaagacgttacgaagtaacgaagtaagcgtaccgtacgtacgtaggtaagtaaacggtaacggttaccaacctaacgtccgtaagaacgtagtaagttaacaacgttaaaccaaagtaactacgtacgtaacgtatactagtaacaaagtacgaacgtacgaaccgtaaagaaccgtaacgaaccgacggttacctagttacgttaagttaggtacggtaaagtaacggtaaagacggtagaacggttgggtacgggtaggtacggttgtagtaacgg

SEQ ID NO: 146670 - DNA, 727 bp, Homo sapiens
  misc_feature: GYAE6OF02IDEOW.21.4.A04.1.454.CMB.1.raw
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
  modified_base (456)..(456): a, c, t, g, unknown or other
  misc_feature (456)..(456): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccgaggccaccctgttctttgtctaccgaggggaaancgcccacctctcctcgacacgcctccgagccagtaactactccaagacgtctactacgacttacgccttaggaccaggaccagaacgccgtacggccgacggtcctccgtacggttccctanacttcgtacgtcgccgttaccggtacccacggacgggccctaacgtcggtaccacgtccgaacgtacggtcgtacacggtggacgtagggttcgggctaggaccgaagttccgttacacgttaccgttanacttcgagttacggacgttacgaacgttcggtaacgtccgtaaggtacgttacttcggaacgttaagttctaaacgtttcgtcggtactaaggttcctaaaggtttacggtacttacggttacctaccgtttcgggttacggttaccgtaccggggtaccgaaacgggttaccggtaacggtaaacggtaaacgtaccggttaaaaccgggttaacgcggggtttaacgtcgtaaccggttacggtaaacccttggtaacccgtttaccgg

SEQ ID NO: 146671 - DNA, 713 bp, Homo sapiens
  misc_feature: GYAE6OF02F1CQ7.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaanagccacctctcctgcagctccagccagaatatccagagctactacatacgcctggtaccaggcaagaacgccgtggcccagggcctcccgacggttcctacattcctatcggccgtcgggtccccaacggacgggcccgtacgtcgggactacgtccccaaggaccgtacgggtttcaggggtcggacgtaggggttcgggtacgtacggggactacggtaccgtttcgacctcgtactacttactaagttacgacaacggtacgttgggaacgtaccgtaggtaacggttacgtttaccggacgtaacggttacgttaacgtttacgttacggtaccgtaacggttactaaggttaacggtacgggttaacggtttaccttaccgttccgtttacggttcccgggttacgggacccggtaacggggtaacccgtaaagggtaacggtaaacgttaacggaaaaccggttacgtacggtggtaccgtagacccgtaaccgtacttacgttaccg

SEQ ID NO: 146672 - DNA, 790 bp, Homo sapiens
  misc_feature: GYAE6OF02GA9AI.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaagcgccaccctctcctgcagcctccgacgccaagaaactactccaaggacgacttaacctacagttacgtcccgttaggtaacccagtaccaaaggaacgtcccgtgggaccccaacggggcccttaaccccgtaacgggtttcccctacgtaacttccgttaagtccggtccggttaccggggttaccccacgggaacggggtccctaacggtcgggacctaccgtaccccgaggtaaccgtacggtttccaaggggtcggaccgtaggggttcgggttcgtacgggggaacctaaggttacccgtttacgactttccgtactacgttccgtaaacgtttacggacgtaacgtcggtaacgggacgtaccgtaggtaacgtacgtttacgacgtagtttagtaacgtttacgttcggtacacggttctaacggttacggtacgttaacgtttccctaacgtttccgttaggttacccggttacgggtaacccggtaacgggtaaccgtaaaggggttaaccaaaaggttaccgggaaaacgttaacggtcggtaacggtcgtaccggtaccgtaccgttacgttcgtaaccg

SEQ ID NO: 146673 - DNA, 808 bp, Homo sapiens
  misc_feature: GYAE6OF02GP16R.21.4.A04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctcggctcccaggctcgagaaaccaccggagaaattgtgttgacgcagtctcgaggcacctgtctttgctcgagggaancgccacctntcctgcagcctcgagccaagaactactccagacgtctaactanagtacgcctggtaaccaggcctaaggaacgtccgtaggacccaagggtccttacccgaagggtttccctagtacttaccgtaagtccggtacgttaccggggaccccaagacggggtaccctaagttccgggactaaccgttacccgaagtaaccggtacggtttcgaacgggtttcgggacctaaggggtttacgggtccgtaaggggaaaccctaggttaacccttttccgaacgtttccctaacgtacgtactaacgtaacggtcgaaacggtaccgtacgggtaaccgtaccgtttaggaaacgttcgtttacggaaccgtaacggtttacgttaaacgttacgttaccgttacgaacggaaccgttaaggttacgttaacgggtaacctttaccgtaaccgttccgttaacggttaccgggttaccgggtaaaccggtaacgggtaacccggtaaagggttaaacggtaaacggttaaacggaaaaccggttacggttaacggttacggggtacctaccgggtaccctaaccggttacgttaccggtttaccgg

SEQ ID NO: 146674 - DNA, 713 bp, Homo sapiens
  misc_feature: GYAE6OF02JG4C3.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaanacgccaccctctcctgcagctacacgccagaatactccagagtcctactacagtagtccgtaggtaccagcaaggaaacgccgtaggacccgaggccctacccgtacggttacctcgaacttcgtacgtcgacggtccgggtacccacggtaccgggaccacgttcggaccacgtaccccgaagtaacgtacggttacctacgggtacgggacgtaacgggttcgggtaccggtacgggaacgtaacggtaccttacaccgttctactacgtaccgtaacgtttacggcgtaaacggtaccgtaggaccgtacttaggtaaacggttattaccggacttaggttacgttacttaacgtcgtacgagtacgtaagttacgtacgtaacgttctaccgttcgtacggttacggtaccggaacgtaacgggtaccgtaagggtaacgtaaacgtacggtaaaccgttcgtaggttaccggtaccgtacgaaccggtaccttaggttccgttacgg

SEQ ID NO: 146675 - DNA, 627 bp, Homo sapiens
  misc_feature: GYAE6OF02F1S76.21.4.A04.1.454.CMB.1.raw
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
  modified_base (427)..(427): a, c, t, g, unknown or other
  misc_feature (427)..(427): n is a, c, g, or t
  modified_base (486)..(486): a, c, t, g, unknown or other
  misc_feature (486)..(486): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggtagttgggctgagtctgggttttcctgttgttatttacaggtntccagtgtgagtgcagcgtggnggagtcgtgggggactacttcggtccagccgtgggacgggtccctggagtacctctccgtgtcgcagcctctcggctattccaccttcgagtacgaccacaactagtcggacgtcgggtccaccgtaggcctaccggaggggacgggctggggagttcggggacgtccgttaataacgaaggtaacgactaaagtcgttacaacggtaacgaagtaacgtaccgggnccggttagtacggtaagtaaagggtaccggttacaacccgtatcgtaacgaaggagtancgtaactaacaaagtacctacaggttataactctaagaccgtaatacgaacgcgtaacctaaggaacccgtaagcgtaacgcgttatagtacgtggaagtacgaaggaagtgtaggtnttacggngttagattgtaggtac

SEQ ID NO: 146676 - DNA, 817 bp, Homo sapiens
  misc_feature: GYAE6OF02H025L.21.4.A04.1.454.CMB.1.raw
  modified_base (368)..(368): a, c, t, g, unknown or other
  misc_feature (368)..(368): n is a, c, g, or t
tcagtcgtcgctcgcacgaccggtgctcgatttagagtagtgatcgagggtaggctctgagagcggtagccccagccccgagaattcccgaggtcgttttcatttggtgatcagcactgaacacagaggactcaccatcggagtttgggctgagtctgggtttccttgttgttattttacagtgtccagtgtgaggtgcaggctggtggacgtccgtgggggatacgttggtaccacgccgttgggacgggtccctggacgaccttcctccgttggtcgcgaacgacccttactcggacctatttcccaccctttacgacgttcgaacccaacgtaaaccgcgttagggaccttacgggggtaccccncccgaaacggggtcccgttaccccggaaggggggtaaccgggggtccttacgggggtaacggttcggggggtcccgggtacccggtttaattaaaccggaaaggaaacggtccgttaaaaccgtaagtttaccgaaaggtaactaaaggaaacgttaccgggccgtacggttcgtaaggtaggaaaaggtaacggttccaaccgtaagtcctaacgaaggtacgaattcgaacttttaacgaaaacgttaacgtactaaccgttacgttaacgtcgtacgaaccgttaaaagtcgaaaaccgtacgacccgtaacggaaaaaccgacggaaccggaccggttaccgttagttaacggtttagtacgggtaaggttaaacgaaacggttaaaaaggcggttaagggtaacgttcgggtacgggttagggttaacgttcggtagtaaccgg

SEQ ID NO: 146677 - DNA, 738 bp, Homo sapiens
  misc_feature: GYAE6OF02JHPF4.21.4.A04.1.454.CMB.1.raw
tcagtcgtcgctcgcacgaccggtgctcgatttagagtagtgatcaggggagagctgctcagttaggacccaggagggaacccatggaaaccccagcgcagcttctcttcctctgctactctggctcccaggctcagaaccaccggtagtaaattgtgttgacgctagtctccaggcacctgtcttgctcgagggaagctccaccgtctccgtgcagtcctccacgaccagtaatactccgagacgtcctacactatacgccgttaggaccagacaaggaacgcctcggacccgtacggtcctaccgtacggttcccacgtacttcctacgtcgtacgtcgtccgtaccccgaggaccgggtcctacgttcgggacctacgtcccgtaggtaccgtacgggttacgacgggtcggacgtacggttacgggtcgtacgggtacctaacgttaccgttccgtacgttccgtacgtacgttacgtaagtacgacggtaacggtacgtcgggtacgtacgtagaacgttacgttcgtacgttaacggttactaaccgtttagtaccggttacgtacggtacgttaggtacgttacgggtaaactttccgtaccgtttcggttacgggttccgtaaccggtacggtaacgggtaaccgttaacgggtaaactaacggttaaacggaaaccggtttagtacgggttaaccgtcggtaaccgtaccgttaccgttacgttaccgg

SEQ ID NO: 146678 - DNA, 977 bp, Homo sapiens
  misc_feature: GYAE6OF02IHCIT.21.4.A04.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagagtagtgatcagggggagctctgagagcggacgccccacgccccagaacttcccaggttgttttactagtttggtgatcagcactgaacacagaggactcaccagtggtagtttgggctgagtcgttgggttttccttgttagtttattttacgaaggttctccaggttgtggtaggtgcgagcgtgggtggaggttcggtagggggatacgttcggtaccagtccgtgggaccgggttcccctagacgtaccttcctccgtgtcgcgtacgccccttntcgacctattaccctaccttacaggtacgaacccaacgtaaactgtacggacgtcgggtcccgtaccgaaggtcccttaaccgggaaggggtaacggggtcgttacggggacgggtttcgggggtacccgggttaacccgttaaacgttaaaccgggaaaaggttaaaaccggtaccttaaaacggtacggtttaaaacaacggttaaacgaacggtaaaccgtacgggaccggttacccggtagtttaacgggtaacgggtaaaaacggggttacgggttaaccccaaacccttagtacccgtaagaaacgggttaacgtaattaaacgggtaactttaaaccgaaaaacgtaaccgttaaccgttaaccgttaggttaacttaccgtaacggtaaacctaaaacggtaacggtaaacccaacggtaaccccgttaaaacgggaaaaaacccgggtaaccggtaaacccgggtaaacccgggtttaccggtttaaaaccgttttaacgttttaaaccggttttaaggggggttaaaccgggttaaaagtaaaaaacccgggttaaaaaagggtaccgggtttaaaacgggttaggtttacggggggtttaaaggggttaacgggtaaccggggtttaaccggttaccgggttaaaacccggg

SEQ ID NO: 146679 - DNA, 820 bp, Homo sapiens
  misc_feature: GYAE6OF02GWWXN.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgcagtcctccaggccacctgtctttgtcctcgaaggggaanacgccacctctcctgccagcctccagccagaactactccagacgctaactacatacgcctaggaccagcgaagaacgccgtaggacccgacggtcctacccgtaggtttccctacgtacttcctagtccggtccgtaccggggtacccaacggtacgggccctacgtcggcctaaccgtacccaaggtacgtacggttccgaaggtcggacggtacggtcgggtaccgtggggtaaccgagttacctttaccgaacttcccgtataacgttactaagtttacgacgtaacggtacggttacggaccgtaaccgttaggtaaaacgtttcgttacggtacgttaaggtttacgtttaacgttacgttacgtaacccggtagttacccgtaaggttaacggttaaacggggttaacctttaccgttaacccggtttaccggttaccgggtttaaccgggttaccccgggtaaaccggtaaaccgggggttaacccgaaaaggggtttaaaccggtaaaacggtttaaacccggaaaacccgggtttaaacgttaggggttacccggttaacggtaccggtaaacccctttaaccgggtaactttcccgggtttaacccg

SEQ ID NO: 146680 - DNA, 835 bp, Homo sapiens
  misc_feature: GYAE6OF02JZXKO.21.4.A04.1.454.CMB.1.raw
  modified_base (148)..(148): a, c, t, g, unknown or other
  misc_feature (148)..(148): n is a, c, g, or t
  modified_base (200)..(201): a, c, t, g, unknown or other
  misc_feature (200)..(201): n is a, c, g, or t
  modified_base (231)..(231): a, c, t, g, unknown or other
  misc_feature (231)..(231): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtctccaggccacctgtctttgctccgaaggggaannccaccttctcctagcagcctaccagccaanatactccaggacgctactacatacgtcctaggtaccagacagaacgcctaggacccagggtccctacccggtagttccctacacgttacctagtacgcccggttccggtacccccgaaggtacccgggggtacccctaccggttcgggaccctaaccgtccccggaagttaaccggtaccggttacgacggtaccgggttacacggggtttacgggtcgtaacggggtactaaccggttacttacccggtacttaccgtactattacccgtaagttaacggtaccgaagtaccggtgggtaaccgacccggttaacgtaaaggttaccgtttaccggacgttaacgggtttcgtttaaaccggttaccgtgtttaacccgggtacgtacggtaaacgtttacgggtacggttaaacccggtttcccgtttaaccgttaaccggtttccgggttaaccgggttacccggggtaaaccggtaacccggggtaacgtttaaacgggggaaaccgtttaaaggtaacccggtaaaaacgggttaacccgtttgggtcccggtaacgtacccggttaaacccggacccttagtttacccggtttaaccg

SEQ ID NO: 146681 - DNA, 795 bp, Homo sapiens
  misc_feature: GYAE6OF02IYOOS.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgttctttgtctccgaaggggaaagacgccaccctctccgtgcacgctccacgaccaagaatactccagacgtacctactaacatacgcctaggtaccacgcaagaacgccgtacggaccgaacggtcccgtaccccgtacggtttccctacgtaacttaccgttaacgtcggtcccgttaccggggtaccccctaacggaccggggtaccctacgttaccgggacctaccgtacccgtaacggtaccggttacggttacgacgggtacggtaccggtagggttacggggtacgtacggggaacgtacgtaccgtttaccgtaaccttccgtacaacgtttaccgtaagtttaacgacgtaacggtaccggtagggtaaccgtccgttaaggtaacttaccggtttacgacgttaaggtttacgtttaacttaacgttcgaacgtacggaaccgttaaagttacggttaacgttaaccgttacccgttaacctttcggtttcggtttacccggttaaccgggaaccgtaaaccggggtaacgtaaacgggtaaacgtaaaggtaacgaaacggtagttcggtacgacgttaccgaccctaagttaccgtgttacgg

SEQ ID NO: 146682 - DNA, 648 bp, Homo sapiens
  misc_feature: GYAE6OF02H761C.21.4.A04.1.454.CMB.1.raw
  modified_base (148)..(148): a, c, t, g, unknown or other
  misc_feature (148)..(148): n is a, c, g, or t
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (592)..(592): a, c, t, g, unknown or other
  misc_feature (592)..(592): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtctcaggcacctgtctttgctcgaggggaancgccaccgtctcctgcacgctccagccagaatactccagagctaacgtanatacgccgtggtaccagcagaacgcctcggccaaggcctaccccgtaggtttccactacttccttaagtcgccgtcgggtacccacggacggccacgtggcacgtcccaagacncggttacacggtggacgtaggtcgggtacgagggacgtagtaccttccgtactctttacgacttacgtaacgtttacggctaacgtaccggttaggacgtcgtaggaagttacgttcgacgttagtcgtttaattacgtggtactacggtagttaacgttagtaacgtacttaccgtaccgtttcgtacggttaccggttaccggacggtaacggtacgtaaacgggttaanaaacggtacgtaaacggtacgttcggtaggtactacggtcaccgttactcgttacg

SEQ ID NO: 146683 - DNA, 719 bp, Homo sapiens
  misc_feature: GYAE6OF02GT3UB.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccaggggaanagccaccctctcctgccagcctccagccagaactactccagacgctaactacatacgcctggtaccagcaagaacgccgtaggccaggtcctacccctaacgggtttccctacacttctagtcgtccgtcggtaccccacgacggtccacgtggactacgtacccgagactacggttacgaggtcgacgtaggttcgggtcgtaggggacagtacttcaacgttctactactactaacgttagactacgacgtaggacgtacctaggtaaacgttgtttaccggcgttaacggttacgttaaccgtttacgtttaccggtaccgtaaggtaccgtaaggttacgttacgggttaaacgtttccgttaacccgtttccggtttacggtttaccggttaccgggtaaccgtaaacggggtaacccgttaaagggtaacgtaaaacggttaaccgggtaaaccggtaacggttaggtacggtacgttacggaacccgtaacgttaaccgttaccgttaacgg

SEQ ID NO: 146684 - DNA, 803 bp, Homo sapiens
  misc_feature: GYAE6OF02H77JG.21.4.A04.1.454.CMB.1.raw
  modified_base (795)..(795): a, c, t, g, unknown or other
  misc_feature (795)..(795): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccggaagaaattgtgttgacgcagtcctccgaggccaccctgttctttgtcctcgaaggggaaagacgcccacccttctccgtgcacgcctccacgaccgagaatactccgaagacgtacctaaccgtactatacggtccttaggtaacccaaggccaacggaaacgtcccgtggaccccgaagggtcccttaccccggtaacggtttcccctcgtaacttccgttaacgttcggtccgttccggggtaccccaaccgggtcgggggaccctacccgttagggcctaaccgttaccccggagtaaccggttacggttaccgaggggtcggtaccgtaggggtttcggggttaccggttacggggaacttaaccgtaacctttccgaaccttcctacccgtattacccgaaatttacccggacgaaggtaacccgtgggaaccggtccggttaacggaaggtttcctttaccggacgttaacgttacggttttaacttacgttggtaccgtaacgtaccgtaaggttacgtaacgggttaacttacccgtcgtttacgtccggtttacggttaccggaccggtaacggtacgtaaaggtaacgaaacgttaacgtaaacggtacgtaggtcgtaccgacgtacctacgtacgttntttcccgg

SEQ ID NO: 146685 - DNA, 747 bp, Homo sapiens
  misc_feature: GYAE6OF02JXAYZ.21.4.A04.1.454.CMB.1.raw
  modified_base (145)..(145): a, c, t, g, unknown or other
  misc_feature (145)..(145): n is a, c, g, or t
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggaggagctgctcagttaggacccagagggaaccatggaaaccccagcgcagcttctcttcctcctgctactctgctcccagctcagaaccacgganaaattgtgttgacgcagtcnccaggcacccgtgtctttgtcctcgaaggggaagacnccacctctcctgcagctccacgtccanaatnccagcgctaanactattacgcctacgtacacgacgacgaacgcccgtagtacccnggtacctacccgtacggttccctactataccgttatcgtccggtcggttaccccacggtaccggccgtatacgggcctagtacccgaagtacgtcgttacgtacgtcggtccngggttacggtcgtacggggaacctaggtacccttccgtaacgtctacgtaactcgaattacggactaacgacgtacggtctacgtaggtaaacgttcgttaaccgtcggttaacgttcgtttaaacttaacccggttgccccgttaagtacgggttaaacgttaccgttgggggttaaactttaccccgaacgttttccggtttaccggttaccggtttaacccgggacccgggttaaaagggccgttaaaaacggggttaaaccttaaaccggtaagtaaaaccccggttaggtttaccgggtagtacccggttacgtaacacccggtttaacttcgttaaccgg

SEQ ID NO: 146686 - DNA, 780 bp, Homo sapiens
  misc_feature: GYAE6OF02G255M.21.4.A04.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtgaggtgcagctggtggagtcggtgggggagtacgttggaccagccgtgggacgggtccctgacgtcctcgtccgtgtcgcacgcctntgctattccaccttcgagtcgaccacaacgtgtcggtaccgtcgggtacccgccgaggccgtaccgggaaggggtacggggtctagggggacggttcggggtaccggtaccggttaaagttaacggaaaggtaacgaccgtaaacgtacggttaactaacggtaacgaaggtaacgtaccgggtctacggttacgttagggtaacgggtaaacgggtaccgtttacaacccgttaagttacccgtaaaggaaaaggtcgtaacttaggttaaaccgttaaaccgaaacggttacctacgtacgtttaacgtaacgtcctaacggaaactaaaacggtcgaaaaccgtaccgttaacggaaaacccgggaaaccggtcggtaacccggtaccggttacgtttaggttaactttacggttacgggtaaagggtaaaccgaaacgttaaaagggtgggttaccgggtatttacggggtcggggttaagtccggtagtaccggtaacg

SEQ ID NO: 146687 - DNA, 797 bp, Homo sapiens
  misc_feature: GYAE6OF02G0KD3.21.4.A04.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagtacgttggtccagccgtgggacgggtccctggacgacctctcctgtcgcacgtcctctgctacttccaccttcagtcgaaccaacaacngtacggacgtcggggtcccnccgagggcccgtaccggaagggggacggggcgtggggaggttcggggccggtaccgttaagttacggaaaggaaacgtacgtaaacgtaagttaacgacgtaacgaagtaagtaaccgggcgtacgtacgtaggtaacggtaaaagggacggtttacccaacgtaactccgtaacgaaaggtagtaacttagggtaaccttaaacggaaaacgtaaccgtacctaaacggttgtttaactccgttacgaaaccgttaaaagtacgaaaaccgtaccggtaacccggttaagggaaaaaacccggtgggaaaccccgtaccgggtacggttttaacgtttaacgttttttacgggtacgggttaaacgggttaaaaccggaaacggttaaaaaacgggtacgggtttaaggggaacggttttaggggttacgggggtttaacggggttaacggttcggttaacggtacccggg

SEQ ID NO: 146688 - DNA, 720 bp, Homo sapiens
  misc_feature: GYAE6OF02GJYLI.21.4.A04.1.454.CMB.1.raw
  modified_base (309)..(309): a, c, t, g, unknown or other
  misc_feature (309)..(309): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcagctggtggagtcgtgggggagacgttggtccagcctggagggtccctgagactctcctgtgcagcctctgcattccacctttcgagtcgacccacaacatgggacgtcgggtccnccgaggcctccggaggggaacggggctagggacggtggggtccggccgtaattaaccgaaaggaaacgtacctaaacgtagttaacaagttaacgaagaaacgtacgggacgtcgttcgtaggtaaggaaaagggtacggttaccaaccgtaactcgtaacgaaggaagtacgtagtaacttaacaaaacgtaaaccttacgtaaccgttagttaacgttactaacgaacgtaaaagtacgtaaaccgacgtaacccgtaaacgggaaaaacccgaacggggaaacccgtaaccggggtacccgttaagttacgtttaaggtttacgggtaagggtttaaacggaaaccgtaaaaagggtacggtaagggttagttacgggtagggttagggtaaggttcgtaggtaccgg

SEQ ID NO: 146689 - DNA, 682 bp, Homo sapiens
  misc_feature: GYAE6OF02I2PNK.21.4.A04.1.454.CMB.1.raw
  modified_base (203)..(203): a, c, t, g, unknown or other
  misc_feature (203)..(203): n is a, c, g, or t
  modified_base (670)..(670): a, c, t, g, unknown or other
  misc_feature (670)..(670): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccacctgtctttgtctccgaggggaaacncgccacctctcctgcacgctccacgccaagaactactccaagacgtacctaactacatacgccttaggtaccagcaagaacgccgtacggcccaggccctccgtaggttcccactacgttactagtcggtccgtccgggtacccacggtacgggccctagtacggactaccgtaccgaagtaccgtacggttcgaggtcggactgggtcgggtacgtgggaactcgtactcgacttctactactacgtactacgactaaggtactaggacgtacgtagaacgttcgttacgacgtagttacgtacttcgtacgtacgtacgtacgtagttacgttacggtaccgttaccttcgttaccgttacggttaccggtaaccgggaaccgtaacgggtaaccgttaaaggtaaacttaccggtaaacgtaaccggtagttcggcggttaacgtaccggtacccgtaacgttntacccgtttacg

SEQ ID NO: 146690 - DNA, 600 bp, Homo sapiens
  misc_feature: GYAE6OF02HMXD0.21.4.A04.1.454.CMB.1.raw
  modified_base (267)..(267): a, c, t, g, unknown or other
  misc_feature (267)..(267): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (492)..(492): a, c, t, g, unknown or other
  misc_feature (492)..(492): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccaggcccgtgggagggtccctgagactctcctgtgcagcctntgcattcaccttcagtcgaccacaacagtggacgtgggtccgccaggctaccgaggggaggggctagggagtgggtcgccgtatacgaaggaagctaacagttacagtacagaatacggcgcgtntagngaaaggtagtccacatcncaaagngattagattacaaaagtactacacttagtactctagacaaaagtcggaaacacgtcctaaaggaaaacccgnggaaaccgaccgggtaccgttagtaacgtttagtttgggtaggtaagaaacgaaaaggtacggtggtaagttcgggtagggttgggtaacgtccggttaggtaaccgg

SEQ ID NO: 146691 - DNA, 755 bp, Homo sapiens
  misc_feature: GYAE6OF02JAT2Z.21.4.A04.1.454.CMB.1.raw
  modified_base (725)..(725): a, c, t, g, unknown or other
  misc_feature (725)..(725): n is a, c, g, or t
  modified_base (740)..(740): a, c, t, g, unknown or other
  misc_feature (740)..(740): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaagaaaccaccggagaaattgtgttgacgcagtcctccaggcaccctgtctttgtctccgaaggggaaagactcccgaccctctcctgaccagcctccgacgccaagaactactccagacgctaactacatacgcctggtaaccagacaacgaagtcctcgggaccccaggtaccctccccgtaaggtttccctaacctactccgttaaggtcgtaccggtacggggtcccccaacggaaccgggtccctaccgtgggcccttaaccgtaccccgaaagggtacccgttacgggtttcccgtaaggggtacggtccggttaagggtccggggttaaccgtgggggaaaacctacgggttaaccccttttacggaaccctttcgtaccgtaacgttacctaagtttaaccggacgtaacggtacggtacggtacaccggtaagtaaaccgttcgtttccgacgtaaggtttcttaaccgtttaaccgttgaaccggtacgtagtaacgttagtacgtacgttctctacgttggtccgtacggtaacccgagggtacgaacggtaataaccgtacggaaacgtaagtaccgnggtactacggaaccncggtacttcttaccg

SEQ ID NO: 146692 - DNA, 759 bp, Homo sapiens
  misc_feature: GYAE6OF02GTLIJ.21.4.A04.1.454.CMB.1.raw
  modified_base (208)..(208): a, c, t, g, unknown or other
  misc_feature (208)..(208): n is a, c, g, or t
tcagtcgtcgctcgcacgaccggtgctcgattttagagtagtgatcagggggagagctgctcagttaggacccagagggaacccatggaaaccccagcgcagcttctcttcctctgctactctggctcccaggctcagaaacccaccggagaaattgtgttcgacgcagtctccgaggccaccctgtctttgtctccgagggaaacgngcccaccctctcctgccagctaccagccagaactactccgagtacgaccttaacctacactacgccgtacggtacccgagaccaaggaacggtccgtcgggaccctaagggtccccttcccccgtaagggttttccccctactacgttaccgttacggtacgggtcccggttccggggtaccccctaacggaccggggtccccctaaaccggttcgggaccacccgttaccccgaaggtaccttacgggtttacgacgggttcgggaccgtagggttcgggttacgtacggggacctacggtaccctttcgtaacccgtttcctacgacgttacgtaacggttccgaccgtaacggtacgtacggtaacgtccgtaagtacgttcgttaccggatacgttagttaactacgttgtacctagtacgtagttacggtacgttaacttctaccgttcggtaccgttcgggttaccgacggttacgaccgttaaggaaaccgataaacccgggaataccggttgccgttacgacgaccgtcctgttacccgttcg

SEQ ID NO: 146693 - DNA, 714 bp, Homo sapiens
  misc_feature: GYAE6OF02JERNF.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaaggggaanagccaccctctcctgcagcctccacgccaagaatactccgagacgcctaactacatacgcctggtaccagcagaacgcctggccaggtcctcccgtaggttccctcacttctacgtcgccgttcgggtacccacggacgggccacgtcggcctacgtaccccagtaccgtacggttacgaggtggacgtaggtcgggtcgtacggggactacggtacttcctaaccgtcgtactacgtactagtttacgacgaacggtacgtggtaccgtaccgtaaggtaacgttacgtttaccgacgttacgttacgtttaaccgttacgttacggtacctaacggtactaaggttacgttacgggtaactttccgtaccgtttcgttacggttacccggttaccgggtaacccggtacggggtaacccgtaagggtaaacggtaaaacgtaacggtaaaaccggtacgttacgggttaccggtacgttaaccggaccgttaccgtacgttacgtttaccg

SEQ ID NO: 146694 - DNA, 793 bp, Homo sapiens
  misc_feature: GYAE6OF02HIELF.21.4.A04.1.454.CMB.1.raw
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcgttgggttttccttgttgtttattttacaaggttgtccagtgtgaggtgcagcgtggtggagtcgtagggggancgttggtccagccgtgggacggtcctgacgacctctcctgtcgcacgtcctntcgcctacttcctaccctttcagttacgaacccaacaaacctagttacgggacgttcggggtaccccgaccgacgggccctaccggaagggggaacgggggcgtaggggagggtccggggtacgggtacccggtttaacgttaacggaaaacgggtaaaggtacccttaaaacgaacggttaacgtaacgaacgaaaggtaaacgtaaccgggcggtcgttaccgtaggttaacggaaagggtacggttacccgaactacgttacctacggaaagagtagttaagtaacttaacgtaaaacgtaacccttacgtaacgtagttactaccgtagaaccgtaaagtacggtaaacctacggaacccgtaaaaggaaaaccccgggagggtaaaccccgaccgggtagtttaagttaaccgtttagttccgggggtaaaggttaaacccggaaagtaaaaccggttaggtaacgggttattttaccggggtagggttacgggttgtacgggttcgtaacgg

SEQ ID NO: 146695 - DNA, 799 bp, Homo sapiens
  misc_feature: GYAE6OF02F7REH.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccctgggagggtccctgacgactctcctgtgcagcctctgcctattccaccttcacgttcgaaccaacaactagtagggaaccgttcgggggtccccgccgtaacggggtcccgtacccgggaaaggggggaaacgggggccgttagggggtaacgggttccgggggttaccggggacccggtttaaagtttaaaccgggaaaaacgggtaaaacgtaccgttaaaaccgtaggtttaaaccgaagggttaaacccaaggtaaaccgtaaccggggtccgtaccggttcgtagggtaaggaaaaggggtacggtttacccaaccgtattacccgtagaaaacggtcgtaaatcggtaaattaacccgaaaaaggtacccttacacgtttagttaactccgtaacgtaactaaaaggttcgaaaacctacgtaccgtaaaccggaaaaccggacggaaccgacccgggtacctttaggttaagtttaacggttagttaacgggtaaacgaaaccgaaaaggttcggttaaggaagtttgggtacgggtagggtacggttcgtaggtaaccgg

SEQ ID NO: 146696 - DNA, 738 bp, Homo sapiens
  misc_feature: GYAE6OF02HYWNP.21.4.A04.1.454.CMB.1.raw
  modified_base (507)..(507): a, c, t, g, unknown or other
  misc_feature (507)..(507): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccatggagtttgggctgagcttggttttccttgttgttattttacgaggtgtccagtgtgaggtgcgagcgtgggtggaggtcggtgggggagtacgttggtccacggtccgtgggacgggtccctaggacgtccttcctccgtggtcgaccgtacgtcccttcgtcgtactactttccgtaccttcgacgtccgaacccaacaacgtagtcgggacgtcgggtcccgcgaggccgtaccggaggggtacgggtcgtagggcgggttcgggtccggtacgttaacgtaacggaaacggaacgtacgtaaacgtacgttacgaagtaacgaaggacgtacggtcgtacgtacgtaggtaaggaaaggttccgtcaacgngttacacggaagacgtatacgaacttacgaaaagtaccttcgaacgttacgtactcgtaacgacgtaaaatccggaaacgtacgtaacccggtaacggaaaaccgggtcggaacccggtacgggttaccgttaagttttacgttaggtttagggaaacggtaaccggaaaacgtaagggtacggttaggtacgtttcgggtaagggttccggtaacgtcggttagtaacgg

SEQ ID NO: 146697 - DNA, 855 bp, Homo sapiens
  misc_feature: GYAE6OF02GXBGX.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcagaaaccaccggagaaattgtgttgacgcagtctccaggcaccctgtctttgtctccgaggggaaancgcccaccctctcctgcagcctccacgcctagaatactccagacgctaactacatacgccgtggtaaccagacgaacggaacggtccgtagggccctaacggtccctaccccggtacggtttccctacgtacttccgttaacgttccggccggttaccggggttaccccaaccggacgggggtacccctacggttcggaccctaaccgtaccccgaaggacgttaccgggtttacagggtcggacggtacgggtttacgggtccggtagggaacctaacgggttaccctttactaccgttaccgttactaagtttaacctaagtttaccggaccgtaacgggtacgttaccggggaaccttaccgggttaaaggttaaaccgttacgttttacccggaggtttaacggttttaccgttttaaacgtttaccggtttacgtaccggtacggttaaacggtaacgggtttaagttacgggtaaaccgtttttaccacccggttttacggttaccggggttaccgtttaacccgggaaaccgggttaaccggggtaaaccggtaaggggtttaaacgaaacggtttaacgggaaaacgttaccggttagggttaccggaccgttaaccgaccgtaacgttacgttccgttaaccg

SEQ ID NO: 146698 - DNA, 755 bp, Homo sapiens
  misc_feature: GYAE6OF02HVAMT.21.4.A04.1.454.CMB.1.raw
  modified_base (603)..(603): a, c, t, g, unknown or other
  misc_feature (603)..(603): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagcgttggttttccttgttgttattttacaggtgtccagtgtgaggtgcagcgtgggtggagtcggtgggggagtacgtttcggtaccagcccgtggggtaccgggttcccgtagacggtaccttccgtcccgtggtcgacctacgtccccttgttcgtacctatttacccctaccctttacgtacggtaccgaacccaaaccgtaaacgagttacgggaccggttaccggggttccccgcccgaagggtcccctaccggggaagggggtaacggggtcgttacgggggaacgggttccgggggtccggaccggtttaacgtaaacggaaaacggaacgtaacttaaacggtaacgttaacgaagtaacgaagtaaacgtaccggcgtcgtacgtaggaggtaaaggtagtaccacatacctacgaagacgtatagtaactaacgaaacgttaaccncaactttacgtataccgaagaaactaaagtacgaacgacgaaccgtaaacggaaaccgacggaaccgtacgggacgttagttaagtttgtagggtaagtaacgaaaggtaaagtggtaggtaagtgggttagggtaggtatcggtagtacgg

SEQ ID NO: 146699 - DNA, 706 bp, Homo sapiens
  misc_feature: GYAE6OF02GDVSA.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccagactcaagaaaccaccggagaaattgtgttgacgcagtctccaggcacctgtcttgctcgaggggaancgccacctctcctgcagcctccagccaagaactctaccagacgactacacatacgccttaggaccagacaagaacgccgtggccacggtcctaccccgtaggttcccagtacttccgtagtcggccgttccggggccccaacggaccgggccctaacggtcggcctaaccgtcccgaaggaccgttacggttacgacgggttcggacgttaggggtcgggtaccgtagggaacctacggtaccttccgtacctccgtctaactacgtacgttacggactacgtaccggtggacgtaccgtaggtaacgtcgtttcgacggttaggttcgttaacgtttcgtcggtatacgtacgtaggttagtacggttaaccgttccgtaccgttccgttcgggttacgttacccgggaacggtaaccgggtaacggtaaacgggtaaggtaaacgtaacgggtaaaccgttagtaacgggtcgacggttaccgaccgtaacttcgttaccgttacg

SEQ ID NO: 146700 - DNA, 784 bp, Homo sapiens
  misc_feature: GYAE6OF02JLIHT.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtgggggagtacgttggtccaggtccgttgggacggggtcccctggacgacctcgtccgtgtcgcacggcctcgtgcctaatttccaccgttcagtacgaacccaacaaccgtagtcgggtacgttcgggtcccgaccgaggtccctaccggaagggggtacgggtcgtagggagggttcggggccggtaccggtaagttaacggaaaggtaaacgacttaaacgagtttaacgagtaacggaagtaacgtaccgggacgtacggttgtacgggtaaggaaaacggtaacggttacgtaaccgtactacgtacgtaagtaagtaagtacgtaacttaacgtaaacgtaacgtaccgtaacgtacgttactacgtacgtaacgtaaacgtaacgtaaacgacgtaaccgtaacggtaaaccggtaacggtaaccggtaaccggtaccgttaacggttaacgtttacttacggggggggggggggttaacgttaaacgggtaaacggtaaaacggtaacgggttaaggtaacggttacgggttagggttacgggtacggttacggttacggtaaccgg

SEQ ID NO: 146701 - DNA, 915 bp, Homo sapiens
  misc_feature: GYAE6OF02G3AWG.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaacccaccggagaaattgtgttgacgcagtctccgaggcctaccctgttctttgtcctaccgaagggggaaacgcgcccctacccttctccgtgcacgctacccgagcctaagaacttacaccaagacgtcttaactacatacgcctaggtacccagaccaaggaacgtcccgtggacccgtacgggccccttaccccggtagggtttccctaccgtaattaccgttaagtcgggtcccgttacccggggtaccccaacgggtaccgggacccctaaccggttcgggaacctaaccgtaccccgaaggtaacccggttaacggtttcgaacggggtttacgggaccgttacgggggtttaccggggtccgggtaacggggtaaaccgttaaccggttaccgttttaccgtaacccggtttaccctacgttaaccgttaaccgttaacggtttaaacccggtaccgtaaacgggtttacggtacccggggttaaccggttaacccggttaaggtaaaccggtttaaaccgtttccggtaacgttacgggttttacgtttaaccgtttaccgtacgggttaccggtaacgttacggttaaccgttaaggttacgggttaacccgtttaccgtaaccgtttccgggtttacggttacccggttacgggaacccgggttacgggtaaccggttaaagggtaaacgtaaacggttaaccgggtaaaccggttacggtaccggtacggtaccgtaccggaaccttaccgtacgttacgttaccg

SEQ ID NO: 146702 - DNA, 757 bp, Homo sapiens
  misc_feature: GYAE6OF02JRYDQ.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctctgctactctggctcccagctcagaaccaccggagaaattgtgttgaccgcagtcctccgaggcctacccttgttctttgtcctccgaaggggaaacgcgccctaccctctcctgcagcctaccagccagaactacgccagacgtcctactacaatacgcctacggtaacccagacgacggaacgtcccgtcgggacccgtacggccgttccccgtacggttacccctctaacgttcctaacgtcggtaccggttaccgggaccccaacggtaacggggacccgtacggtcggtccaaccgttacccgaagtaccggtacggttacgacggtacgcggtacggtcgggtcgtagggtaacacggttccttaccgacttcgtactaactactacgtacgacgtacgacgttccgggaacgtccgtaacgggtaaacgttcgtttacggacgttacggtttacgtttaacgttacggttactacggtaacggtaacgttagtaaccgggtttaacgggttaaccgtacgtttaccgttacggttacgttccgggttaaccgaccggtaacgggtaaccgtagggttaaaccaaggttaacgaaacgtaacggttggtacgtccgtacgaacctacgtacgttcttaacg

SEQ ID NO: 146703 - DNA, 864 bp, Homo sapiens
  misc_feature: GYAE6OF02HJMXH.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggcaccctgtctttgtctccgaggggaaangcccaccctctcctgcagcctccgagccagaactactccagacgccttactacagtacgccgtggtaaccagccgaagaacgccgtggacccacgggtcctcccgtacggtttccctacgtacgtccttaagtcggccggttaccgggtaccccgaacggtaccgggccctaaccgtggacctaacctccccgaagtaaccgtacggttcaggttcgggcgtacgggtcggggttactacggggacctaacggtacctttccgaaccgtttccgtactacgttaccgtaacgtttacggaccgtaacgggtaaaccggttgggtaaccggtaccggttaacggtaaaacggttacgttttacccggtaacggtttaagggtttaccgtttaacgttttaacccgttcggtttaaccggtaacggttaaccgttaacgggtttaacggttaaccggggtttaaaccgttttacccgtaacccgtttccgggttaaccggtttccggggttaacccgggtaccgggttaaaccggggtaaaccggtaaaggggttaaacggtaaaacggttaaaccgggtaaaaaccggttaacggttaaccgggttccggtaaccggttaccgtaaccccggtaacgttttacccggtaccggttttacccgg

SEQ ID NO: 146704 - DNA, 677 bp, Homo sapiens
  misc_feature: GYAE6OF02FIFJD.21.4.A04.1.454.CMB.1.raw
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtggagtcgtgggggagtacgttcgggtccagtcccgtgggacgggtcccctggacgacctctccgtgtcgcacgcctctgctacttcacctttcagtcgaccacaacngtggactgggtcccncgagcctcggagggacgggctaggaggtcgggtcggacgttaagtaacgaaggaacgacgtaagtacgttacagtaacagtaacgtacggcgtcgtcgtggtaacgaaggtacgtcacctatcgtaacgaaggatagtagtaacttaacaaaggttacctacctaacgttacgtactacgtagaaccgtaagaacgtaacaaccggtaccgtaacgtaaaaccgggagtaacccggtaccggtacgttacggtttatttacggttacggttaaggtaaacgtaaaacggtaaagtaacgggttagaacggttgggtttaacgggtaggtttaccggtagtttacgggtaaccgg

SEQ ID NO: 146705 - DNA, 609 bp, Homo sapiens
  misc_feature: GYAE6OF02IRD12.21.4.A04.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtagtgatcagggagctctgagagcggagccccagccccagaattcccgaggtgttttcatttggtgatcagcactgaacacagaggactcaccatggagtttgggctgagcgtggttctgtgtattcaagtgtcagtgtgagtgcagctggtgagtcgtggggganacttgggtccaggcctggacggttcccagaggactcgtcctggtacgcaagcctcgtgcattcacctttcagttcgacccataacgatggacctggggtcccgaccaagggcctaccgagggaaggggtctaggacgttgggtcggccgtataccgaaggtaagctaacgagttacagtacagaagtacgnaccgtnagtcgaaaggaagttcaactagtcctagagagatagattacgaaacgacttacgaactgtaagtcacgtacaaacgacgaacgactaccgtaacgtaaaaccgnggtaaacccaggacccgtagttactaacggttcgtaagggtaactaacgtaaaacggtagtaacggtacgtaggttacgtagggtaacgtaccgtaggtaacccg

SEQ ID NO: 146706 - DNA, 722 bp, Homo sapiens
  misc_feature: GYAE6OF02IMVDB.21.4.A04.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtagtgatcaggggagagctgctcagttaggacccagagggaaccatggaaaccccagcgacagcttctcttcctcctgctactctggctcccaggctcagaaaccaccggagaaattgtaggttgacgcagtctccaggcaccctgtctttgtcctcgaaggggaaancgccacctcctcctgcacgctccngaccagaactcgtccagtacgctaactacatacgcgtacgtaccagacgaacggaacgcctggtccacggtcctacccgtaggtttccagacttctagtcgccgtcgggtacccacggcggaccctacgtcggcacgtacccgaaggtaccgtaaggtccgaagggtggaccggtagggtttacgggtacggtcgggtaaccgaacgttaccgttacgtaccgtctacgtacttacgtaagtttaacgacgtaacgtacggtacgggtaacnccgtaggtaaacgtttcgttacgtacgttacggtttacgttaactttcgttacggtacgaggtactaggttaacgttacgggtaacttccgtaccgttcgttcgttaaccgggtccggttaaccggaacggtaacggttaaacggtaagttaaacggtaaacggtaaaccgtaacgttaggaaccggttagacccgtacgaacgttaccgttcgttaacgg

SEQ ID NO: 146707 - DNA, 743 bp, Homo sapiens
  misc_feature: GYAE6OF02JO7HC.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggagacttggccagcctgggtacgggtccctggagtacctctccgtgtgccacggtcccttctaggcctactttacccaccgtttaccgagttaccggaacccacaacgtacggtacgggtaacgttccggggtccgaccgtacgggtcctaccggaaggggggaacgggtcgtaggggtaacgggtcggggtacccgggtaccgttaacgttaacggaaacggaacgtacctaacgtaagttaccggagtaacgaagtaacggtaccggcgtacgttcgtagaacgggtaaaggtacggttcccaaacggtactaccgtacgtaaaggagtaactacgtaataccgaaaaggttaacctcgtaacttgggtaactacggtacaacgtaaagtaccgaacgtaaccgtacggtaaaccgaaccggtaaggaaccgtaccggtaccgttagtacgttagtaggttaacggaagaacgtaaaaggtcgggttagtaacgttgggtaaacgggtaggtacgttagaggtaaccg

SEQ ID NO: 146708 - DNA, 820 bp, Homo sapiens
  misc_feature: GYAE6OF02IPBVY.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaaccaccggagaaattgtgttgacgctagtcctccaggcaccctgtctttgtctacgaggggaancgccaccctctccgtgcacgcctccacgcccagaactactaccgagacgctacgtacagtacgccgtacgtaccagacagaacgccgtcggccgtacggcctacccgtacggttacctactacttcgtacgttcgaccggttccggggtaccccaacggtacggggtaccctacggttacgggaccctaaccgtccccgaaagtacccggttaacggtttacgaacgggtttcgggacgttacgggtttacggggttacggtacggggtaaccgacgttaacccgtttaccgacccttttaccgtaacccgttaagtaacccgttaacgttaacgacccgtaaggtaccggtacgggtacgttaccgtaaaggttaacggtaacgtttccggtaaacttacgggtttaagttaaccgtttacgtacggttaccacgtacgtttacggtaacggtttacggtaacgtttaccgtaccgtttacggttaccggtaccggttaccgggtaaccggaaccgggtaacgttaaacgggtaaacgtaaacggtaaccgggtaaacgtacgggtttacggaccggttaacgtaccggtaactaacgttaccgttcgttaaccgg

SEQ ID NO: 146709 - DNA, 809 bp, Homo sapiens
  misc_feature: GYAE6OF02FPXP4.21.4.A04.1.454.CMB.1.raw
tcagtcgtcgctcgcacgaccggtgctcgatttagagtagtgatcagggggagagctgctcagttaggacccagagggaaccatgggaaaccccagcgcagcttctcttcctcctgctactctggctcccaggctcagaaaccaccggagaaattgtgttgacgcagtctccgaggccaccctgttcttttgtcgtccgaagggggaaagcgcccacccttctcctcgccacgcctaccgacgaccgaagtaactactaccgagacgtactaacctacaacgttacgccttacgggtaaccacggaccgaaggaaccggtcccgttacgggaccccggtacgggtcccccttaccccggtccgggtttaccctacgttacgttaccttacgtcggtcccggttacccggggtaccccacgggaccggggacctaaccggttcgggacctaccctacccgaaggtaccgttaggtttaccgagggtcgggtcggtagggtcgggttcggtagggaaaccgtaggttacccttccgtactaccgtacgtactacgttaacgtacgaccgtacggtacggtcggtaaccggtacgtagtaacggtttacgtttacgtacgtaggttacgttaacttcgtcgtacgtacgtacgttagtacggtaggtttaaccgttaccgtaccgttcggttaccggtacgggttacccgggaaccgggtacgggtaacggtaacgggtaaagtaaaccggtaaggttaaacgttacgtacgggtaccttcggtaccgtacgtaaccgttacgtgtttaccg

SEQ ID NO: 146710 - DNA, 736 bp, Homo sapiens
  misc_feature: GYAE6OF02I45DC.21.4.A04.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggacctcaccagtggagtttgggctgagtcgttgggttttccttgttgttattttacgaaggtgtccagtgtgtaggtgcagcgtgggtgggagtcggtgggggatacgttggtccgaggccgtgggacgggtccctggacgacctctccgtggtcgccgacgtcctgtacgtctaacgttcctacccgttagagttaccgaaccctaataacaacgttcgggaacgtcgggccccnccgacggtccgtaccggaggggaacgggtcgtagggtagggtcgggtaccggtacgttaagtaacgaaaggacgtaactacgtagtacagacgagaacgtacgcgtgtcgtagtaaggtaaaggtacgtaacacgtataccgtagaaaggtagattagtaactaacgaaacgttacgtactaacgttatacgtacacgaaactaaacgtaacgaaaccgttaacgaaccggtaaacgaaaccggtacggactaacccgggttacgttaacgttaggttaacgtttacgggtaaacggttaaacgtaaaggtaaaaaggttcggtttaaggaacgttggggtacgggttagggttaccgttacggttacggtaaaccgg

SEQ ID NO: 146711 - DNA, 729 bp, Homo sapiens
  misc_feature: GYAE6OF02HO92P.21.4.A04.1.454.CMB.1.raw
  modified_base (279)..(279): a, c, t, g, unknown or other
  misc_feature (279)..(279): n is a, c, g, or t
tcagtcgtcgctcgcacgaccggtgctcgatttagagtagtgatcaggggagctctgagagcggagccccagccccagaattcccaggttgttttcatttggtgatcagcactgaacacagaggactcaccatggagtttgggctgagcttgggttttccttgttgttattttacgaaggtgtccagtgtgaggtgcagctggtggagtcggtgggggatacgtttggccaggccgtgggtacgggtccctagacgacttctcctgtgcgacgtccctntacgctaatttccaacctttcgagttacgaacccaactaaacgtgttacggacgttcggggtcccgacccgaggtccgtaccggagggggaacggggtcgtagggaggttcgggcggtacgtaaagttaacggaaacggtaagacgtaaaacgtagtttaaccaaggtaacaaaggtaacgtaaccggcgtacggttcgtaaggaaggtaaacggtaaggttccgaactacgtacctaacgaaagaagtagtaacgtaagtaaaccgaaaggtaacttacgaacgttacgtaacttacagtaacaaacgttaaggaacaaccggtaccgtaaacggaaaccgaacggtaccgaaaccggtcgttaagttagttagttaggtaaggtaacgaacgtaaaaggacgggttaggtaagttacgggtagggtaggtacgtacggtagtaaccgg

SEQ ID NO: 146712 - DNA, 744 bp, Homo sapiens
  misc_feature: GYAE6OF02IAHK1.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtgttgacgcagtctccaggcaccctgtctttgtctcgaggggaaagcncctaccctctcctgcacgtcctccagaccaagaaatactaccaagacgtaccttaactacaacgtacgccgttacgggtaccaacggacgaaggtaaaccgccgtcgggacccgaacgggcccttaccccggtaaggtttcccgtctaacgttctaacgttcggccgttacggggtccccacggacggggaccacgtcgggtaccacttaccccgaaggtactacgggttcgacggttcggacgtacgggtgggttacgtacgggacgtaacgtacttacgtacgtacttacgtacttacgtaagtttacgacgtaggtacggtacgggtacgtacggtaacggtaacgtttgttaccggacgttacggttacttaacgtttacgtcgtacgacgtagttacgtaagttaggttacgttccttaaccgttcgttcggttacggtaccggtacggtaacgggtaacgtaagggtaacgtaaacgtaacggtaaacggtacgtttagggacggttacgtacgtccggtaacttaccgtgtttacg

SEQ ID NO: 146713 - DNA, 766 bp, Homo sapiens
  misc_feature: GYAE6OF02HJTK3.21.4.A04.1.454.CMB.1.raw
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagtctgggttttccttgttgttatttacgaaggtgtcctagtggtgaggtgcagctagggtggagtcggtgggggagtaccgttggtccaggtccgtgggacgggtccctaggagtaccttcctccgtgtgacacgtcctctgctacttcctaccttcacggtcaaccaacaacgtatcggacgtcgggtaccgccgacgtccgtaccgaacggggaacggggtaccgtcgggtaacggggtcggggtacccggggcggttaacgttaaccggaaacggtaaacggtacctaaacgtaaggtttaaccgaaacggttaacgaaggaacgttaccgggacgtaccggttacgttaggaacggaaaacgggttacggtaacctacgtacgttacgtacgtaaaggtacgtaagtacgtaacgttaacgaaacgtaactaccgtatactagtctagtaactaagtaacgaacacgtaacctaacggtaaaccgaaccggtaaacgtaccgggaccgttaagttacgtttaaggttacggtaaggttaaaccggaaacgtaaaagggtaggtagggttaacggttacgggtagggtaacggggttcgtaacggttggttaaaccgg

SEQ ID NO: 146714 - DNA, 670 bp, Homo sapiens
  misc_feature: GYAE6OF02FP0TB.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttggtccagccgtggacgggtccctgagactctcctgtgcagcctctgcattcaccttcagtcgacccacaactagtgggaccgttggggtcccgaccaggtcctacccggaagggggaacggggcgtagggggacggttgggggtaccggtaccgttaagttaaccgaaaggaaagtacctaaacgaggtttaacaagttaacaggtaaacgtacgggcgtacgtcgtagtaggaaagggtagttaccacgtatctacgaaagagaatagacttacgaaaaggtaaccttcgaacttagttaactacgtagtacctaaaagtacgaaaaccgtacggtaaccttaacgggaaaaaccggcggaaacccgtaacggtccgtagttagttacgttggtaaggtaacgaacgtaaaaggtggtacgagttggtaggtggtacgtcgtggtacg

SEQ ID NO: 146715 - DNA, 681 bp, Homo sapiens
  misc_feature: GYAE6OF02HF3GJ.21.4.A04.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgttgacgcagtctccaggcaccctgtcttcgtctccgaggggaancgcccacctctcctgcagtcctccgagcctagtatactaccagtactctaactactatacgcctaggtaccagtacagaacggccgtggaccgngggtcctcccgtacggttcctacgatctacgcgtaccgtcgggtcccaacggacggtccacgtggacctacgtacccgagacgtacggttacaggtcgacgtacgggtcggtacggttacgggctaaggttaccctacgtaaccttcgtactacgtacctagtacgacgtaagtccgtaggacgtacgtagaaacgtctttacgctaggttcttaacgttactcgtagacgtactaaggtacttaaccgggtaacttccaccgtttcgttacggtaccggtttaccgggacggtaacggtaccggttaaagggtaaccgaaaggtttaacggaaacgttaaaggttccggtaacgttccggagtaaccgttaccctaggtttctacg

SEQ ID NO: 146716 - DNA, 878 bp, Homo sapiens
  misc_feature: GYAE6OF02JX2NQ.21.4.A04.1.454.CMB.1.raw
  modified_base (201)..(201): a, c, t, g, unknown or other
  misc_feature (201)..(201): n is a, c, g, or t
  modified_base (686)..(686): a, c, t, g, unknown or other
  misc_feature (686)..(686): n is a, c, g, or t
tcagtcgtcgctcgcacgaccggtgctcgatttagagtagtgatcaggggagctctgagagcggagccccagccccagaacttcccaggtgttttcatttggtgatcagcactgaacacagaggactcaccatggaggtttgggctgagcgttgggttttccttgttgtttattttacaaggtgtccagtgtgaggtgacngcgtggtggagtcgtgggggagtacgtggtccagccgtggacggtccctgagacctcgtcctggtcgacgacggccttcgtcgcctaacgtttcacccttacgtacgtcgaaacccacaaacctagtaccgggtaccgtccgggtacccgtacccgtaacggccgtacccggaagggggtaaaccgggggccgttagggggaacggtttccgggggttacccggggaccgttaaccggttaaaccggaaacgggaaaacggtaccgtaaacgtaacggtttaaaccggtaacgtaaacggtaaagtaaacggtacggccggtaaccgttggtaaggttacggaaacgggtaaacggttcccaaccgtacgtaaccgtaacgaaagtaggtaaattacggtaaactttaacgaaaacggttccttaaaccgtaaacgtttacgtaccggtttacaacggttaaactaaagtaaccgaaaacccggngttaaaccccggtaaaccgggtaaaacccgtaaaccgggaaccggtacccgggttagttaaccggttttagttacgttaaaggggttacccggttaaaaggtaaaacctaaaaaggggttaaccggttagggaaaggttttcggggtaaacgggtttacgggtaacggggtttaccttaaagggtaaccggg

SEQ ID NO: 146717 - DNA, 765 bp, Homo sapiens
  misc_feature: GYAE6OF02GWALC.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccacccttgtctttgtctaccgaaggggaaanagtcccacctctcctgcagcctccagccaagaatactcagatctactacatacgcctggtaaccagcaaggaactccgtcggacccaaggtccctccccgtaggtttccctacacttaccgtatcggtacccggttcgggaccccaaggaccgggtcccctaaggttcggacctaaccgttaccccgaaggttacgtacgggtttacgaacgggttggaccgttagggtttgggtacctggggaaaacctcggtttaattcccacgtttcctacgtactcttaacgttagcgtacgacgttcggacgtcgtaaggtaacgttacgtttacgagttacgttacggtttactaaggttccgtacggtaacgtacgttaaggttacggttaacgggttaacgtttaacccgtcgtttaaccggttcggttaaccgggtttccggaaccggtaaccgggaaacccgttaaagggttaacgaaaacggtttaacggaaaaccgttaacggtttacgggaccggttccgttaaccggaccgttaaccgtaccgtttccgtttacgg

SEQ ID NO: 146718 - DNA, 641 bp, Homo sapiens
  misc_feature: GYAE6OF02FYAHH.21.4.A04.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtcttgtctccgagggaacngccacctctcgncgagcctcagcaagatacctcgagtctactacgactatacgtccgtacgtaccagtacgaagtaacgccgtacggcgtacggtcctacccggtacgtcctanacgttactagtccggtacgtccggtaccaggtccgtccacggtcgaccgtccgtaccgacgtacgtacgtcgtacggtccggtacggtaaggtccgggtacgtacgggtaactaacggttcccttacgtacttcgtactacgtacgtagtacgacgacgtacgtacggactcgacgtacgtcgttacgagtacgttactcgttaagtcgtctacgtacgtagtacgtacgttacgtctacgttgttacgtacgtcgtaccgtacggtaacgtacggtaacgaacgtacgtaaccgtgtacggtactacggctaccacgtagttacctcg

SEQ ID NO: 146719 - DNA, 672 bp, Homo sapiens
  misc_feature: GYAE6OF02IOB9S.21.4.A04.1.454.CMB.1.raw
  modified_base (309)..(309): a, c, t, g, unknown or other
  misc_feature (309)..(309): n is a, c, g, or t
  modified_base (457)..(457): a, c, t, g, unknown or other
  misc_feature (457)..(457): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccacggagaaattgtgttagacgcagtctccgaggcacctgtctttgctcgaaggggaaagcgccacccttctcctgcacgctccagccaagaatactcagacgtctaacacactacgcctacggtaccacgcaaggaaccgccgtgggccaacggtcctccgacggttcncgtatcgtagtcggcgttccgggacctacgacgggtaccacgtggcctacgtcccaggtaccgtaggttccaggtcggacgtcgggttcggcggtacggactacgttaccgtctacgtcgtactactacgttatacgacgtacgtacncgggtaacgtcgttaagaacgtagttcgacgttagttacgtaagttacgtacgtagtcgtacttaaggtagttaaccggttacttaccgttccgtacgtacggtttaccggacgttaaccggtacggaaacggttacggtaaacgtaaacggtaaggttaaaccggtaacggttggacggttacctacggaaccttacgtaccgttagttaccgg

SEQ ID NO: 146720 - DNA, 709 bp, Homo sapiens
  misc_feature: GYAE6OF02I1T7A.21.4.A04.1.454.CMB.1.raw
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcagaaacccaccggagaaattgtgttgacgcagttcctccgaggcctacccgtgttcttttcgtcctaccgaagggggaaagccncccctaccctctccgtgaccacgcctaccgacgaccgaagtaactactccgaagacgtacctaacgtacaagtacggtaccctacgggtaaccncgaccgtaaaggaaccggtccgttacggacccgtaacgggtccccttaaccccggtcggtttaccctactacgttccttagtccgtaccggtccggtaccacgacggtccagtcgacctccgaccaggtaccgttcgtacgnggtccggngtacgggtcgggtacgacgggaacctacgtcttacgacttctgatacgtagtacgacgtagtacgtacgctacgtaagacgttacgtcgagttacgttntaaccgttntacgtcgagtacgtacgtagttacggtaatttcccacgtttcgtccgggtacgttacgaccgaacgtaaccggtagttaacggaagttaacggtaaccgtaacgtggttacgacgtcggaacctcgtaccgtattccg

SEQ ID NO: 146721 - DNA, 899 bp, Homo sapiens
  misc_feature: GYAE6OF02IQ1VN.21.4.A04.1.454.CMB.1.raw
tcagtcgtcgctcgcacgaccggtgctcgatttagagtagtgatcagggggagagctgctcagttaggacccagagggaaccatcggaaaccccagcgcagcttctcttcctcctgctactctggctcccaggctcaagaaaccaccggagaaattgtgttgacgcagtctccaggccacctgttctttgtctcgaaggggaaagacgccaccctctcctgcacgcctaccacgaccagtaaactactccaagtacgtaccttaacgtactaacttacggccttcgggtaaccacggactaacgggaacgccgtcggacccgacgggtacccttaccccgtaacgggttttccctacgtaacgtttaccgtttaaggtcgggtaccggttacccggggtaacccccaacgggaaccgggggtccctaacggtcgggtacctaacgtacccggaaggtacgtacgggttttaccgaaggttcgggacgttaggggttccggggttacgtacggggaactaacgttaccgttaccgtacgtttacgtactaacttacgtaacgttttaaacggcgtaaacggtccgggtaaggtaccggtacccttaagggtaaaccggttttacgtttaaccgggacgtttaacggtttaaggttttaaccgtttaccgggtacgtaaccggtaacggttaacgttaaacgggttttaggtaaacgggttttaaaccgtttcccgtaacccgttttcgggttcggttttaaacccgggtacccgggtaaaccggtaaaccggggttaacgtaaaaccgggttaaaggttaaaaaccgggttaacgaaaaccgggttaacgttttcggacggtaccgttacggtaaaccttacgacgttttacgttaccgg

SEQ ID NO: 146722 - DNA, 708 bp, Homo sapiens
  misc_feature: GYAE6OF02J10NM.21.4.A04.1.454.CMB.1.raw
  modified_base (299)..(299): a, c, t, g, unknown or other
  misc_feature (299)..(299): n is a, c, g, or t
  modified_base (657)..(657): a, c, t, g, unknown or other
  misc_feature (657)..(657): n is a, c, g, or t
tcagtcgtcgctcgcacgaccggtgctcgatttagagtagtgatcaggggagctctgagagcggagccccagccccagaattccccaggtgttttcatttggtgatcagcactgaacacagaggactcaccatggagtttggctgagtcttgggttttccttgttgttattttacgaggtgtccagtgtgaggtgcagtctggtggagtcgtgggggagtacgttggtccgagtccgtgggacggtcccgtgagccgttctccgtgtacgcgacgtcctcgtgactacttccaccttcngttacgaccacaacacgttggaccgtcggtcccgcgaacggcctaccggaggggtaacgggtcgtgggtacggtcgggtcggaccgttacgtaacggaaaggaacgtacctaagaggtttaaccgagtaaccaaggtaacgtaccggcgtcccggtagtaggtaacgtaaacgggtaaacgttcaaacccgttacgtactaaccggaagtagtaactaggtaactaaccgaaacggttaactaccgtaagtacggttaatcgtaacgtaacaaacgtacgtaaacgaccgtacgaaacggtaaacccgtaacggacgtacccggtaacgttgttaagttcggttaaggtacggttaanaacggttaaagtgggtagttagtcgggtaggttaagtggtacggtgtacgg

SEQ ID NO: 146723 - DNA, 679 bp, Homo sapiens
  misc_feature: GYAE6OF02HU7MR.21.4.A04.1.454.CMB.1.raw
  modified_base (189)..(189): a, c, t, g, unknown or other
  misc_feature (189)..(189): n is a, c, g, or t
  modified_base (355)..(355): a, c, t, g, unknown or other
  misc_feature (355)..(355): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttggttttccttgttgttattttacaaggtgtccagtgtgnggtgcagctgggtggagtcgtggggggagtacgttggtccaggccgtgggtacgggtccctggacgactcctcctgtgcagccctctgctacttccaccttgacgtacgaccaacaacagtcgacgtcgggtccgccaggcctccggaaggggaacgggcgtgggnggtcgggtcggtaccggtagttaacgaaaggaaatctaaacgtagttacaagtacagaagtaccggcgtcgtacgtagtagggaaaggtacggttacgaacctacgttaccagtaaacgagtatacggtaattaacgaaaataccctactacttagtactatacgaataaacgtacgaaacgacgtaacctaacggaaaacccgaggaaccgacgggttaccgtagtttaactttaggtttacggtagttaaacggaaacgtaaaagggacggttagggtacgttcgggttaagggttagggtaacgttcggttaggtaaccgg

SEQ ID NO: 146724 - DNA, 730 bp, Homo sapiens
  misc_feature: GYAE6OF02JI55F.21.4.A04.1.454.CMB.1.raw
  modified_base (142)..(142): a, c, t, g, unknown or other
  misc_feature (142)..(142): n is a, c, g, or t
  modified_base (148)..(148): a, c, t, g, unknown or other
  misc_feature (148)..(148): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccnccgganaattgtgtgacgcagtctccaggcaccctgtctttgtctccgaggggaagcgccaccctntcctgcagcctccagcccaagtaactactccgaagcgcctaactacgatacgcctggtacccagcagaacgcctcggccaggccctaccccgtacggttaccctacacgttaccttagtcggtccgtaccgggtaccccaacggtacgggaccctacgtcggaccaccgtacccgagtacgtaggttccaggtcggtacgtacgggtgggtacggtacgggaactacggtaccttacccgaacttcctacgtaacttacgtaacgtttacggaaccgtcggtaacggtaccgggtaacgtaccgttaagggtaaaacgttccggttttaacccggacgttaacgttacggtttaacccgttacgttcggtaccgacggtacgtaaggttacgttacggttaaccggttaccttacccggttcgttacggttccgttaccggaccggaacggtacggtaaggtaacgtaacgaacggtaaaccgtggtagtcggacgtaccgaccgtacgtcgttacgtaccg

SEQ ID NO: 146725 - DNA, 646 bp, Homo sapiens
  misc_feature: GYAE6OF02FNCID.21.4.A04.1.454.CMB.1.raw
  modified_base (154)..(154): a, c, t, g, unknown or other
  misc_feature (154)..(154): n is a, c, g, or t
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccacggagaaattgtnttgacgcagtctcaggcaccctgtctttgctccgagggaaancgccaccctntcctgcagctcagccagactnccagacgtctactacagtacgcctggtaccagtcaagaacgtcctggccaacggctaccccgaggttccctcgacgttctatccgtcgtcgggtacccacgacgggtacccacgttcggctacgtcccgagacgtacggttcaggtcggcgtacgggttcggtctacggggaactacggtaaccgttccgtacttaccgtcgtacttacgttaacttacggtactaacggtcgtacgggccgtaccgtaggtacgttaacgtttcggactaggtttacgtacttacgtcgtacacggtactagtatacggtacttccgtacttacgtcgttaccgtacggtacgtaacggtaccgtaggtaacgtaacgtaacggtaacgtacgtggtacggtactacggtcctaagtacgtcgttacg

SEQ ID NO: 146726 - DNA, 733 bp, Homo sapiens
  misc_feature: GYAE6OF02HLTHG.21.4.A04.1.454.CMB.1.raw
  modified_base (203)..(203): a, c, t, g, unknown or other
  misc_feature (203)..(203): n is a, c, g, or t
  modified_base (606)..(606): a, c, t, g, unknown or other
  misc_feature (606)..(606): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggtcaccctgtctttgtctccgaggggaaanctccgacctctctcgcacgcctccacgccaagtaatactaccaggacgtacctaactactactacgcctaggtaaccaggtacagaaccggccgtacgggacccgacggccctacccgtacggtttccgactactcgttagtcgtaccgttcgggtacccaacggtacggggtccctacggtcggacctaccgtacccgaaggtaacgtacgggttacgaagggttcgggacggtttagggggttccggggtacggtacggggtaaccgtaaggttacccgtttaccgtaacccttcgtacccgtaattaccggttaacttacggaaccgaacggtaccggtacggacgttaccggtagtaacggttcttacggacgttaggttacgttacttacgtgtaccngtaccgtaggtagtacggttactaccgtacttcggttcgtacggtacgaacggtacggaacgtaaggtaacgaacgtaacggtaacgtacgtaggttcggacgtactaccgacttcgtccgttacgg

SEQ ID NO: 146727 - DNA, 859 bp, Homo sapiens
  misc_feature: GYAE6OF02GH0H9.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacgttggtccagccgtgggacgggtccctgacgactctcctgtgcagcctctgcattccaccttcagtcgaacccacaactagtcggacgtcggggtcccgaccgacggcctaccggaagggggaacggggtcgtaggggtagggttcggggtccggtaccggtttaagttaaaccggaaagggaaaacgtaccgttaaacgaacggtttaacgaaacggtaacgaaacggtaaacggtaccggggaccgtaccggttacggttagggtaaacgggtaaaaacggggtaacgggtttacccaaacccgtaagtttaccctaacggtaaaacggaacggttaacggttaacggtaaaccgtttaaaccggaaaaaagggttaacccttacgtaaccgtttaacgggttaccttaaccgttaagaaacccgttaaaagtaaccgaaaccgtaccgtaaacccgtaaaacggggaaaaaccccggacgggtaaacccggaaccggggttaacccgtttaaggtttaacgtttaacggtttacgggtaaggtaaaaccgggtaaacgtaaaaaacgggtggttaacgggtaacggtttacggggttaacggggttcggttaaacggttaccggttagggtaacccgg

SEQ ID NO: 146728 - DNA, 797 bp, Homo sapiens
  misc_feature: GYAE6OF02G3GJE.21.4.A04.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttggtccaggcctgggacggtccctgacgtactcgtcctggtcgcacggtcctacgtgcctacttcctaaccttcaagtcgaaccaacaactagtggacgtcgggtccgaccgaggccgtaccggaggggaacgggtcgtagggacggtcggggtccggtaccgttaagttaaaccggaaagggtaaacgaccgttaaaacgtaacgttaaccgtaacgtaacgaaaggtaaacgttaccgggacggtaccgttacggtaggtaaggaaaacgggttacggtttacccaaacccgttaattaccgtaacgtaaaacggtagtaagtacggtaaacgtttaacgaaaaacgttaaccttccgtaacgttagttaacttcgaagtaacctaaaggtaccgaaacgtacgtaacccgtaacgggtaaaaaccgcggtaacccggtaaccgggtaccgtttaagtttaacgtttacggttaacgggttaaacgggtaaaccgtaaaacggtaaaccgggttaggtaaccgggttaaggttcggggttacggttaaggggtcgttaacggtacggttaaaccgg

SEQ ID NO: 146729 - DNA, 698 bp, Homo sapiens
  misc_feature: GYAE6OF02GRQT5.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacccttgtctttgtctccgaaggggaaanagccacctctcctgcagctccagccagaactatccagagctaactacatacgccgtaggtaccagcgaagaacgcctacggaccaggcctaccaggttccctacacttctatcgcgtcgggtacccaacgcgggacctacgtggacctaacgtcccgaagaccgtaggttacaacggtcggtaccgtagggttcgggtcgtaggggaacctaagggtacttccacgttccgactaacgtactaattaacgctaaaggtacgttagggacgtaccgttaacggaaagttacgtttccgaagtacggttacgtaacgtttacgtctaccgagtacgttaggtaacgtaggtaacgtttaccgtacgttcgttacggttaccgttaccggaccgggttaaacggacggtaaacggtaaagtaaaacggttacgggtaaaaccgacggtttaggtaaccggtacggttacaacccgttacgtaccgttaccgtttaccg

SEQ ID NO: 146730 - DNA, 777 bp, Homo sapiens
  misc_feature: GYAE6OF02H9SLX.21.4.A04.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagagtagtgatcaggggagctctgagagcggagccccagcccccagaattcccaggtgtttcatttggtgatcagcactgaacacagaggactcaccatggagtttggctgagcttgggtttcttgttgttattttacaaggtgtccagtgtgaggtncagctggtggagtcgtgggggagtacttggtccagtccgtgggacggtcccgtaggagtaccgtcctccgtggtcgccacgtcctcgtacgtctacgtttacctacccttcgagtacgaacccaccaaactacgtcgggaccgttccggggtcccgaccgacggtcccaccgggaaggggaacggggtctacgggtagggtcggggtaccggtacgttaacgtaaaccggaaaggtaaaacgtccgttaaaacgtacgtttaacaacggttaacgaacggttaaacgtaccggtacccggtcgttacgtaggtaagggtaaaacggtaacggttaccaaccgtactacgtacgaaagtacgtaagtagtaacgttaacgaaacgttaaccttactaacttagtaccgtactaacgtaaacgtaaagtaacgtaacgaacgtaaccgtaaccggaaaaccggtaaccggaacgtaacccgggtacgttagttaacgttagtttacggtaaggtaacggtaaacggtaaaaggtacgtaagggtaggtttacggtacgggttagggtacgtaccggtaggttaaccgg

SEQ ID NO: 146731 - DNA, 647 bp, Homo sapiens
  misc_feature: GYAE6OF02F9C9G.21.4.A04.1.454.CMB.1.raw
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtggtggagtcgtgggggagacgttggtccagccgtgggagggtccctggacnctctcctgtgcagcctctgctattccacctttcagtcgaccacaactatacggaccttggggtcccnccgaggcctaccggagggggtaaggggcgtagggacggttcggggtccggtacgttaattaaccgaaaggaaacgctaaacgtagttacaggtaacaagaactacgggcgtcgtntaggtagaaagggtacgttacgaccatctacgaagagtatggtatacgaaanactacactatatacgtnaactaanagtaacagtaaccgtaacgaaaaccgcggaaaccaccgggtaccttagttaatttacgtaggttaacggttaagaaacggttaaaacggtaggttaggtacgttagggttaggttcgggtaacggtaggttggtaaccg

SEQ ID NO: 146732 - DNA, 698 bp, Homo sapiens
  misc_feature: GYAE6OF02FUEJ6.21.4.A04.1.454.CMB.1.raw
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (590)..(590): a, c, t, g, unknown or other
  misc_feature (590)..(590): n is a, c, g, or t
tcagtcgtcgctcgcacgaccggtgctcgatttagagtagtgatcaggggagagctgctcagttaggacccagagggaaccatcggaaaccccagcgcagcttctcttcctcctgctactctggctcccaggctcaagaaaccaccggagaaattgtgttgacgcagtctccaggcaccctgtctttgtctcaggggaancgccacctctcctgcagcctccagccaagtaactactccagacnctaactacatacgcctaggtaccagcagaacgcctggaccaggcctcccgaggttccncatctagtgccgtcgggtacccacgacgggccacggtggacctacgtcccgagtaccgtaggttcaggtcgggaccgtagggtttcgggtaccgttaggggaacctacgggtaaccttttccgaaccgttccgtaccgtaacgttaccgtaacgtttacggaccgtaacggtaccggttcgggtaacgtacccggttaaggtaacgttaccgtttaccggtacgtacggtttagttacgtttacgtcgtacgtagtacgtaagttagtacggtaacgttccaccgttnttcggttacgtaccggtaccgtaacgggaccgtaagggtaacgtaaacggtaacggtaaacgtaacgttaggtacggtacctacgaccgtaccgttagtaccgttacg

SEQ ID NO: 146733 - DNA, 1002 bp, Homo sapiens
  misc_feature: GYAE6OF02JMQH0.21.4.A04.1.454.CMB.1.raw
  modified_base (148)..(148): a, c, t, g, unknown or other
  misc_feature (148)..(148): n is a, c, g, or t
  modified_base (230)..(230): a, c, t, g, unknown or other
  misc_feature (230)..(230): n is a, c, g, or t
tcagtcgtcgctcgcacgaccggtgctcgatttagagtagtgatcaggggagagctgctcagttaggacccagagggaaccatggaaacccagcgcagcttctcttcctcctgctactctggcctcccaggctcagaaaccaccgganaaattgtgttgacgcagtctccaggcaccctgtctttgtactccaggggaaagtgaccctaccgtccttcgtgccgagtccncccaggacccaaggaacttacggtcccaggaacgtaccttaactaaccgtaacgttcgaccggttacgggttaaaccccaggaaccgtaacggaaacggttcccttaacggggtccccgtaacggggccctttaccccccgtaaacggggggtttttccccttaaccggtacggtcctttaaccggttccgggtacccgtaaccgggggttcccccaaacgggttaccgggggtacccaccggtacggggtacctaccgttaacccccgggagtaccgtaaaccggttttccgaaaccggggtttgggaaccctgggggttttaaccggggccgtacggggggttaaaccctaaccggggttaacgttttccccgaccggttttaacccgtttacgaaccttaccggtaaccgtttaagggttaccctaaacggtaacccggttaccgggtaacggtaaacccggttcggtaaaacgggttaccggttttaccaacgggtttaacgttacggtttaaccggttttaaacccgttcgtttaccggaacggtacccgttaaggttaagggtaaccgggtttaaaacggttacccgacgttttaacccgggtttaaccggttccggttttaaacccgggccgggttaaacccgggtaccggtttaaacgggttaaaccgggttaaacgtaaacggggtttaaaacggaaccgtttaacgggttaccggtaaccggttggtaaccccggggtaattccggttaaccgtttacccgg

SEQ ID NO: 146734 - DNA, 727 bp, Homo sapiens
  misc_feature: GYAE6OF02IFC79.21.4.A04.1.454.CMB.1.raw
  modified_base (197)..(197): a, c, t, g, unknown or other
  misc_feature (197)..(197): n is a, c, g, or t
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtagtgatcaggggagctctgagagcggagccccagccccagaattcccaggtgttttcatttggtgatcagcactgaacacagtaggactcaaccatggagtttggctgagcttgggtttttccttgttgtttattttacaaggtgtccagtgtgaggtncagctggtggagtcgtagggggatacgttggtcacggcctgggacggtcctaggacgtactcgtcgngtgctagcctgacgctacttcaccttgaacgtcgacccanaaacgtgtcggacgttcggggcccaccgaggccgtaccggaagggggaacggtcgagggtacggttcggggtaccggcgttaagtaaaccgaaaggtaactactaaacgtacgtacgaaagtaacaaggaacgtaccggcgcgttatagggtaacggaaaggtaacggtaccaaccgtaagttccaaagtacgacgtaagtacgtaataacgaaacggttaaacctactaacgttacgttactaccgtataacgtaaagtaagaaccgtacgtaacgtaaaccgggaaaccgtaccgggaaaccgtcggtacgtacggtttaagtttacgtttagggtaaacggtaaacgtaaaaccgggtaaaggttaacggtaaggttaggtacgggttaagggttacggtaacgtacggttaggtaaccg

SEQ ID NO: 146735 - DNA, 792 bp, Homo sapiens
  misc_feature: GYAE6OF02HMXZR.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaaagacgccaccctctcctgcacgctccacgccaagaactactccagacgctactacatacgcctaggtaccagcagaacgccgtcggccaggcctcccgtacggtttccctctaacttccttacgtccggtacgttccggggtacccccaacggaccggggtaccctaaccggttcgggaccctaaccgttaccccgaaggtaacccgttaacgggtttccgtaacgggtcggggtacccgtaagggggtttccgggggtacgggttaacggggtaaacccgtaacgggtttaacccgtttaccctaacccggtttcccttacctaagttaccgttaacgtttaccgggaccgtaaacggtacggttacggggaaccgtccgttaaggtaaacggttaccgttaccggtacgttaggttacgtttacttaaccggttcgtaacgtacgtacgtaaggttagttacgggtaaactttccgaccggtttcgttaccgggtttaccggttaccgggaacccgtaacgggtaacggtaaaggtaacgtaacgtaacggaaaccgtacgtggtacggctaccgactaacgtcgtacttcg

SEQ ID NO: 146736 - DNA, 721 bp, Homo sapiens
  misc_feature: GYAE6OF02FRIMJ.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgaggggaangccaccctctcctgcagcctccagccagaatactccagagctactacatagcctggtaccagcagaacgcctggccaggcctcccgaggttccctcacttctagtcgccgttcgggtaccccacgcgggccacgtggacctactccccgaagaccgtaggttcgaggttcggacctagggttcggggtctacggggaactaggtacctttacgaccttcctacgtaacttacgtaacgtttacgactaacgggtaccgttgggaaccgtaccgttaaggtaaacgttacgtttaccggacgttaaggtttacggtttaactttaccgttggttaacccgaagttaccgtaaggtttaacgtacgggttaaacgtttcccgtaacccgtttcggttcggttacccgggttaccgggaaccggtaacggggtaacccgtaaaggggtaacgttaaaacgtaacgggtaaaccggttaacgttgggtacggtacctacggacccgtaccttacgttcgtttaccg

SEQ ID NO: 146737 - DNA, 713 bp, Homo sapiens
  misc_feature: GYAE6OF02JGSMJ.21.4.A04.1.454.CMB.1.raw
  modified_base (196)..(196): a, c, t, g, unknown or other
  misc_feature (196)..(196): n is a, c, g, or t
  modified_base (243)..(243): a, c, t, g, unknown or other
  misc_feature (243)..(243): n is a, c, g, or t
  modified_base (474)..(474): a, c, t, g, unknown or other
  misc_feature (474)..(474): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccaccggagaattgtgtgacgcagtctccaggcaccctgtcttgtctcgaggggaancgcccacccgttctcctgcagcctccgacgccagaatactccaagcnctactacactacgcctggtacccagacgaagaacgccgtcggacccgacggtccctacccgtcggttccctaccgtacttcgtacgtcgtccggtaccggtccccacggacgggacccctaacgtcggacctaccgtacccgaagtaccgttaacggtcgacgggtggaccgaggtcgggtcggtacgggaactacggtaccttctacgttctactacttagtacgttacncgtaaggtaccgtacgggacgtaccgtaagtaaggttacctttaccggtacttagttacgtttacgttcgttacgtaccgtaggtaccgtaaggttacgttaaggtacgtttaccgtaccgttacggtttcggttacccggtacggaacccggttacggtaaccggtaaggtaaacggtaaagtaacggtaacgtacgtacggtacggtacgtaccggacctaacggttactgttaccg

SEQ ID NO: 146738 - DNA, 805 bp, Homo sapiens
  misc_feature: GYAE6OF02HGFAT.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttcctttgttgtttaattttacgaaggtgtccagtgtgaggtgcagctggtggagtcgtgggggagtacttggtccagcccgtagggacggtccctgacgacctcctccgtgtgccacgtccctcgtcgctaacttcctaaccttcgacgtacgaacccaaccaacgtagttaccgggacgttcggggccccgccgacggtccgtaccgggaaggggaaggggtcgttagggggacggttcggggtacccgggtaccgttaaacgttaaccgaaaaggtaacgtaccgttaaacgagtttaaaccgaagttaacgaaaggtaaacgtaccgggtaccggtcgttacgtggttaaaggtaaacgggtaaacggttacccaaccgtaacgttaccgtaacgtaaagaacgtatagtaacttaacgaaacgtaactacgtacgttacgtattacgtagtaactaaagtaccgaaacgtaacgaaccgtaacggaaaacccgtaacggaaacccgtaccggtaccgttaagttacgtttaacggtttacgggtaagggttaaaccggtaaaggtaaaaacggttaggggtttaaggtaacggtttaggggttacgggtttacgggtttaacggttaccggttagggtacccgg

SEQ ID NO: 146739 - DNA, 807 bp, Homo sapiens
  misc_feature: GYAE6OF02JEZTE.21.4.A04.1.454.CMB.1.raw
  modified_base (358)..(358): a, c, t, g, unknown or other
  misc_feature (358)..(358): n is a, c, g, or t
  modified_base (515)..(515): a, c, t, g, unknown or other
  misc_feature (515)..(515): n is a, c, g, or t
tcagtcgtcgctcgcacgaccggtgctcgatttagagtagtgatcaggggaggctctgagagcggaggccccacgcccccacgaacttacccacggtcgttttctatttggtgtatccagcaactgaacacagaggactcaccagtggagttttgggcgttggagtcgttgggtttttccttggtttgtttagtttttacgaaggttcgtccgtaggttgttgaggtgccgtaggtctgggttggaggtgttggggggagactttaggtcccgtagcccgttggacgggtcccgtgacggactctccgttgtcggacacgccttctcggcctatttccaccgtttcacgtgaacccanaaccatcggacgtcggggtaccgcccgtaacgggccttaccggaaggggtcggggacgcgggaaggtcgggggtcggggaccgtagttaccggaaaggtaacgaccgtaacgaggttaacagttaaccggagtaaacgtaacggggctaaccgggtntaccgggttaaggaaacgggtaacggttacgaacccgttagttacccgacgttaaagacgggtaattacggaaacgttcgaaaactaaacggtaacccgtaacgttacgtaaacgttttcaaaccgggttacaaaacgttaccgggaaaactcgtaaacccggtacgaaaacccggaaacgggaacgtaaaccgaccggttacggtactttaaggtaccgtttaagggtaacgaacgtaaaggaacggttacggtaggtacggttaggaggggttacgttgaggtttaccgg

SEQ ID NO: 146740 - DNA, 711 bp, Homo sapiens
  misc_feature: GYAE6OF02G5G1O.21.4.A04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaattgtgttgacgcagtctccaggcaccctgtctttgtctaccgaggggaaancgccacctntcctgacagctcagccaagaatactaccagacacctacacatacgcctaggtaccagcgtaagaacgccgtggacccaggtcccttacccgaggtttcccacacgttcctagtcggaccggtttccgggaccccaggtaccggggaccctacggtcggacctacgtacccgaaggtaaccgtcggtttacgacggttagggcctaagggttcgggacgttacggggacctacggtacttccaccgttctacgacgttactaacgtttacgacggtaacgtaccgggttacggtaacggtaccgttaggtaaaccggttacgtttacccggagtttaagtttcggttaaactttcggtacgttaacgaggttactaagggttacgtaggtacctttccgtacttacggtttcgtaccggttacggaccgtaacgggtactaacgggtaataaacggtacaaacgtcgttaggtacgcgttcgaacctccgtactcgttacgg

SEQ ID NO: 146741 - DNA, 728 bp, Homo sapiens
  misc_feature: GYAE6OF02HGLWS.21.4.A04.1.454.CMB.1.raw
  modified_base (173)..(173): a, c, t, g, unknown or other
  misc_feature (173)..(173): n is a, c, g, or t
  modified_base (715)..(715): a, c, t, g, unknown or other
  misc_feature (715)..(715): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttanaaggtgtccagtgtgaggtgcagctggtggagtcgtgggggagtacgttggtccaggccgtaggacgggtccctgagactctcctgtgcagcctctgctattcaccttcagtcaaccacaacagtcggacgtcgggtccgaccgaggcctccggaggggaacgggtcgtaggggaggtcggggtacggaccgttaagttaacggaaacggaaagtacctaaagacggtttaacacgtaacgaagtaaacgtaacgggcgtacgtcgttaggtaagggtaaaacgggtaacggtttaccaaccgtaacttaccgtaacggaaagtaaggtagtacggttaaacttaacgaaaaacggtaccttaacgtaacgttacgttactacgtacgtaaactaaagtaaccgaaactaaccgaccgtaaacggtaaaccgtaacgggaaccgaaccggtaccggttaagtagttttaacgttacgggtaagggtaaaccgaaacggtaaaaggtacggtagggtacgttagggttggtaacgggttacgnggttacgtaacgg

SEQ ID NO: 146742 - DNA, 511 bp, Homo sapiens
  misc_feature: GYAE6OF02G4D6X.21.4.A04.1.454.CMB.1.raw
  modified_base (475)..(511): a, c, t, g, unknown or other
  misc_feature (475)..(511): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgggagtttgggctgagcgttgggttttccttgttgttattttacgaaggttgtccagtgtggaggtgcagtcgtggtaggagttcggtggggggtaatacgttcgggtacccacggtcccgtagggacgggtccccgtaggacgtacctcctccgtggtcgccgacgtcctcgtgccgtacttccgtaccttaccgagttacggaaccaacaaaccgtagtacgggaaccgttccgggggtcccgacccgtacgggaccttaccgggaaacgggggtaacggggtcggtagggggacgggttcgggggtccgggtaacccggttaagtaaccgggtaaaaacnnnnnnnnnnnnnnnnnnnnnnnnnnnnnnnnnnnnn

SEQ ID NO: 146743 - DNA, 706 bp, Homo sapiens
  misc_feature: GYAE6OF02JEWDZ.21.4.A04.1.454.CMB.1.raw
  modified_base (211)..(211): a, c, t, g, unknown or other
  misc_feature (211)..(211): n is a, c, g, or t
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
tcagtcgtcgctcgcacgaccggtgctcgatttagagtagtgatcagggggagagctgctcagttaggacccagagggaaccatcggaaaccccagcgcagctcctcttcctcctgctactcgtcggcctccaggctcaacgaaaccaccggagaaattgtgttcgacgcagtctccgagccaccgtgttctttagcctacggaagggaancgcctacccgtctccgtgccagtcctacgacgaccaagtaaactactaccgaagtacgtaccttaacctaactaacgtaccggtacccttaacggggaaaccacggtaaccgaaacggaacgtccggtacggacccgtaacggccccgttacccgtaacgggtttccctaacgacgttccgtacgtcgtcccggtaccggtcccgaacggtacggccaacgtcgacctacgtacccgagttaccgagttcgagtcggcgtaggtcggacgtaggacacttaccgtcctacgtcgtactacgtagtacgtacgcgtaacggtcggtacgaccgtaggttacgtaaacgttcgtacggtacgtacgttaagttaccttacgtgtaacgacgtacgttagtacgttacgtacgtactcgttcgtagtaccgtacgaacgtacggaacgtagtaacgtacgacgtacgtatggacgttacncgtanacgtctacgttcg

SEQ ID NO: 146744 - DNA, 736 bp, Homo sapiens
  misc_feature: GYAE6OF02I1J36.21.4.A04.1.454.CMB.1.raw
  modified_base (114)..(114): a, c, t, g, unknown or other
  misc_feature (114)..(114): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (633)..(633): a, c, t, g, unknown or other
  misc_feature (633)..(633): n is a, c, g, or t
tcagtcgtcgctcgcacgaccggtgctcgatttagagtagtgatcaggggagagctgctcagttaggacccagagggaaccatcggaaaccccagcgcagcttctcttcctctnctactctggctcccaggctcaacgaaaccaccggagtaaattgtgttagacgtcagtctcgagccacctgtctttgctcgaagggaacncgcctacctctcctggcacgtctaccacgtccaagtaactanccagacgctacgtacatcgccgtcggtaaccngacaaggaacgccgtcggacccgtagtcccgtaccgtacggttaccctacgtacttacgtacgtaccggttccggttaccggtacccctaaacggggacccgggtacccttaacggttccgggaccctaaccggttaaccccgaaggttaaccggtacggtttaccggtaacgggtcgggtaacctaccgggggttggggttacccgttaaggggaacccgttaagtttacccgttaccgtacggttacctaacgttacgttaccgtacgtttaaccgtacggacgtttacgtagggtacccacggttaaagtaccgttaacgtcggttaactacgtttagtaccttagtccgtanacgttaccgtagtaaccgtgttacgtactacgttcgtacgtcgtacgtacgacgacgtagtaacgacgtacgaagtgtacgcgtactcgactgtactacgttc

SEQ ID NO: 146745 - DNA, 761 bp, Homo sapiens
  misc_feature: GYAE6OF02HZHGR.21.4.A04.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccaccggagaaattgtgttgacgcagtctccaggcacctgtctttgctcgagggaancgccacctctcctgcacgctaccacgccaagtaatacgtaccaagacgtacctaactacagtacgccgttaggtaaccagacaaggaacgccgtaggacccgaacggtcccttacccggtacggtttccctactaacgttccgtaacgtcggtaccggttccgggtaccccaacggacggggtaccctacggtcggtacctaaccgttacccggaaggtaccgtacggttacgacgggtcggtacgtaagggttcgggtacgtacggggactaacgtaccttcgtaccttccgtaacgtacgttacgtaacgttacggacgtaacggtacgtacgggactaccgtaagggtaacgttacgtttaccggacgttacggttacgttaaccttacgtacgtaccgaagttacctaaggttacggtacggttaaacgttccgtaccgttacggttacggttacccgggttacggaacccggtaacgggttaacgtaacgggtaaacgtaacgtaacggaaacgtacggttcggtacggtacgtacgacccgtaacttcgttacgttacgg

SEQ ID NO: 146746 - DNA, 912 bp, Homo sapiens
  misc_feature: GYAE6OF02GW9CP.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccagtggtagtttgggctgagtcgttgggttttccttgttgttattttacgaaggtgtcctagtgtgaggtgcagtcgtgggtggagtcggtgggggagtacgttcggtccagtccgtagggacgggtcctagacgtacttcgtccgtgtacgcgacgtcctcgtcgtacctactttaccgtaccttcgaacgtaccgaacccctaactaaacgtacggtaccggtaccggttaccggggtccccgacccgggtaacggtacccgtaccggggaaaggggggtacggggtacggtacggggtacggggttcgggggtaccccggtaaccgttaacgttaaacggaaaggtaaacgtaccgttaaaacgtaacgttaacgaacggttaaccgaaaacggtaaacggtaccgggccggttacgttaccggttaacggtaaagggtaaaccggggtaaccggtaacccgtaccgtagttaaccgtaaccgtaaagtaacggtagttaaacggtaactaaaccgtaaacgttaaacgtccgtaaacgttacgtaaacgttacgtaacggtaaacgtaaagtaaccgtaaaccgtaaccgtaaccggtaaaccgggaaaacccgtaaccgggtaaacccggtaccggttacccgttaacggttacgtttaaaggtttacggttaaaccgggtaacggttaaaaacccggtaaaacgggttacggttaacgggtaagtttcggggttaaacggggttaggttaacccggtacgggttacggttaaccggg

SEQ ID NO: 146747 - DNA, 827 bp, Homo sapiens
  misc_feature: GYAE6OF02IH191.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccagactcagaaaccacggagtaattgtgttgacgcagtctccaggccacctgtctttgtctaccgaggggaancgccctacctctcctgcagcctcagccagtaactactccaggactacctaatacaattacggcccgtaggtaacccaggaacaacggaaccgtccgtacgggaccctaacgggtcccttaccccggtaaggttttccccagtaacttcggttaacgtcggtcccgtaccgggttaccccacggtaccggggtccccttaaggccggtaacctaccgtacccggaacggttaccgtaaccggttggtaccggtacggtacggttacggggtttccgggtacggttaaccgggggaactaaccgggttaccctttaacgacccgtttactaccgtacgtttaacgtacggtttaaaccggacgtaaggtaaccggttacgggacctacggtaagtaacggttacgttcggacgttaagttcgtttaaccgtcgtcggtaaccgttacggaaccttagggttacggtaacggtttacccgttaacccgttacgttttccggtaggttaccccgggtaaccgggtaaacccgggtaacgggtaaccggttaaggaaaacggttaacgttaacgggtaaaccttacgggtgtaccggtacggccgtaaccgtacctttagtaccgtttacc

SEQ ID NO: 146748 - DNA, 967 bp, Homo sapiens
  misc_feature: GYAE6OF02GY94O.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggtcgtcaccggagtaagttgtcttgacgcagtctccaggccaccctgtctctgtctccgagggaaagtgtactctctcctgacgaaggccagtacagtacgtgttggcatcggtacgttgcccgttagggtaacccaaaacgtaaaaaccgtcggaccgaacggtacctaccccgtaacggttccttaccttacgtaccgttcgttaacggttcgggggacctaacgttcccgtaaccggtacgggtaccgttaccgggaacccggtcctaaccgttaccccggaacggtaacccgttaaacgggtttcccgtaaacgggttccgggtaccccggtaaacggggtttccgggggttaaccttaccgggggggaaacccgttaacgggttaaaccccttttccggtaaaacccctttcccgttaaacccgggtaaccccgttaaacccttaaacggttaaaacccccaaaaccgggtacccgggtttacccggggtaacccgggtttaacccgtttaagggtaaaccgttttaccgggtttttaccgaaccgttaacgggtttacggtttaaaccgttaccggtttacggttaaccggttaaaggtttaccggttaggtttaacggttaacggggttacccgttaccgtaaaccccggtttaccggttaccggttttacccggggaaccggggtaaccggggtaaaccggttaacgggtagggaaacgttcggtaaccgtaacggtaacggaccgtttcgggacggtaccgtacgtaacccgtacgtacgtttccggtacgtttaaccgttcgtttaccgtacccggtttcccacccg

SEQ ID NO: 146749 - DNA, 728 bp, Homo sapiens
  misc_feature: GYAE6OF02FVGO2.21.4.A04.1.454.CMB.1.raw
  modified_base (201)..(201): a, c, t, g, unknown or other
  misc_feature (201)..(201): n is a, c, g, or t
  modified_base (707)..(707): a, c, t, g, unknown or other
  misc_feature (707)..(707): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcgaggccacctgtctttgtctccgaggggaaancgccaccctctcctgcagcctccacgccaagaactactccgaagacgactactacatagcccgttggtaccaggcaggaacgcctcggaccacggtcctacccgtcggttaccctacgtattaccttagtcggtccgttccgggtaccccaacggacgggccctaacgtcgggacctacgtcccgaagaccgtaaggtttcaggtcggtactacgggtggggttacacggggaactacggtaccttacgactccgtataactcgtacttacgcgaacgtacgtcgggaactcggtaacgaacgttaccgttacggtacggtagtttacgtttaacttacgttcggttacgaacgtccgttaaggttacgtaacgggttaagttacccgtacgtttacgttcggttaccgggttaccggaacccgtaacggggaacccgaagggttaacgtaaacggttaacggtaaacccggtacggttaaggtcccggtattcccgggtaaaccnccggttaccttcggttaaccg

SEQ ID NO: 146750 - DNA, 542 bp, Homo sapiens
  misc_feature: GYAE6OF02FWU5S.21.4.A04.1.454.CMB.1.raw
  modified_base (200)..(200): a, c, t, g, unknown or other
  misc_feature (200)..(200): n is a, c, g, or t
  modified_base (289)..(289): a, c, t, g, unknown or other
  misc_feature (289)..(289): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccacctctcctgcagcctccagccagaatatccagagctaactacatagcctggtaccagaagagcctggccaggctcccgagttccnatctatgctggtcccagagggccacgtggccatccccagacnggttcagtcggcnggtcgggtcnggggacagtacttcactcgtcatcattagctagacgtggagcctagaagtattcgntagtgtattctgtcagtctagtatagtacgttcaccgtcgtcgtcgttcggaccgaagggtaccaaggtacgaaacgtacggtaaacgtaacgtacggtacggacgtacgaccgtacctactcgtgttaccg

SEQ ID NO: 146751 - DNA, 695 bp, Homo sapiens
  misc_feature: GYAE6OF02JX1L0.21.4.A04.1.454.CMB.1.raw
  modified_base (673)..(673): a, c, t, g, unknown or other
  misc_feature (673)..(673): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggctaccctgtctttgtctcgaggggaagagccaccctctcctgctacgctccacgtaccagaatactccaagacgtactactacatacgcctcggtaccagccaaggaacgtccgtaggccgaaggcctaccccgtaaggttccctacgaacgtcttagtcggtccggtccgggaccctacggacgggcctacgtcggaccacgtccgacggtacgtacggtacgaggtacggcgtagggttcgggtacgtagggacgtacgtacttaccgtacgtcctactagtactacggtttacgacgagtacggtcggtacgtacctaaggtacgttaacgtttccgtacgtacgtttacgttacgttcgttacggtaccaacggttacgtaaggttacggtaacgggttaacttcgttaaccgttcggttacggtccggtttaacggaaccggtacggtagtaacgggtaaacgtaagtaacgtaacgttacgtaggtcgtacgngaccttacgtagtacgttaccg

SEQ ID NO: 146752 - DNA, 760 bp, Homo sapiens
  misc_feature: GYAE6OF02HWNE3.21.4.A04.1.454.CMB.1.raw
  modified_base (199)..(199): a, c, t, g, unknown or other
  misc_feature (199)..(199): n is a, c, g, or t
  modified_base (494)..(494): a, c, t, g, unknown or other
  misc_feature (494)..(494): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaccaccggagaaattgtgttgacgcagtctccaggcaccctgtctttgtctcgaggggaanactcccaccctctcctacgcacgcctccagccaagtaatacgtccagacactaactacagttacgtcctacggtaaccaggaccgaagacgccctgggaccaacgggtcctaccccgtaggtttccctactacttacttaacgtcgggtccgttaccggtccccctaacggaccgggggccctaacggtcggacctaccgtcccgaaggtaccgtacgggtttaccgagggttcggacgtaggggttcgggtacggtacgggaactacggttaccttaccgtacgtcttaaccgnttaaccgtcgtttaagcgtaacgtacgttagggaaccttccgtaaagtacgttagttccgtacgtaaggttacgtttacgttacgtcggtaccgaagttccgtaagttaccgttaggttaaccgttacccgtccttggtaccggttaccggtttccggaaaccgttaccggggtaacgttaagggttaaacaaaccgggttacgtaaacggtaaccggttggttacggacccgttagaacccgttaacgttccgtgttttacccgg

SEQ ID NO: 146753 - DNA, 768 bp, Homo sapiens
  misc_feature: GYAE6OF02JYXYO.21.4.A04.1.454.CMB.1.raw
  modified_base (140)..(140): a, c, t, g, unknown or other
  misc_feature (140)..(140): n is a, c, g, or t
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcaggggagagttgctcagttaggacccagagggaaccatggaaaccccagcgcagcttctcttcctctgctactctggctccaggctcagaaaccnccggagaattgtgttgacgcagtctccgagccacctgtcttntctaccgagggaaancgccctacccgtntcctgcacgcctccgagccaagaattacgaccaggactacctacgtaacagtacgtccgtacggtaccaaggacaagaacgtccgtaggaccgacggtcctacccggtaaggttcccctactacgttaccgtagtcggtaccgtcgggttaccccgaaggtacgggccctaacggtcggtaccctaaccgtcccggaaacgtaccggttacgggtttaccaggggttacggtaccgttaaggggttcccgggtacgggttaacgggaccttaagggtaccttaccggtacccttacgtataccgttacgtaacgttacgacgtacgttacggaggtaccgtacgtaggtaacgttcgtacgtagttaaacgttcgttacgttacgtagtacgtacgttagtagttaacgttaggttaacttccgtacgtttacgtttaccggttaccgggttaacgaaccgggaccgttaacggaaggttaacggaacgtaacggtaaacgtcgggtttaactaggtccgtacgtaaccgttaccggttacttcggttcgttaaccgg

SEQ ID NO: 146754 - DNA, 806 bp, Homo sapiens
  misc_feature: GYAE6OF02I8HK5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggttttccttgttgtttattttacaaggttgtcctagtgtggaggtgcagcgtggtggagtcgtgggggacgtacgttgggtacccaggtcccgtgggacgggttcccgttggacgtaccgttccgttccgttgggttgaccgacgtccgttcgtcgtactaacgtttcctaccgtttcacggttaccgaacctaaccaacgtacgttcgggtaacgtcggggttaccccgaccgtaacggcccgtaccggaacgggggaaacgggtcggtacggggtaggtccgggggtaccggtacccggttaaagttaaccggaaagggtaaacgtaccttaaaacggtacggtttaaacgagttaaaccggaggtaaaacggttacccgggtcggtaaccgttcgtagggtaaacgggtaaacggtaacgggttaccaaccgttaacgtaccgtacgaaaggtaacgagttaaccgtaacgttaaagaaacgttaaccgtacttacgtagtacttcgtaggaaactaggtaacaacgtacgtaccgtaaaccgaaacgacgaacggaccgttaacgtaggttactaggttacggtaaggtaacgtaaacggtaaaggtggtaaggagttacgggtaggtacggtacggttcgtacggtaacg

SEQ ID NO: 146755 - DNA, 772 bp, Homo sapiens
  misc_feature: GYAE6OF02JYCHW.21.4.A04.1.454.CMB.1.raw
  modified_base (207)..(207): a, c, t, g, unknown or other
  misc_feature (207)..(207): n is a, c, g, or t
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaatttgtgttgacgctagtctcaaggccaccctgttctttgtcctcgaaggggaaacncgcccacccttctcctggcctagcctccagccaagaactactccaagacgtctaactacagtacgtccgtaggtaccaggactaagaacgtccgtggaccgacggtcctaccccgaggtttccctcattccgtaagtcgtaccggtccggtaccccaggacgggccctaacggtgaccaagttccccaaaggtaccgtagggttccaggggtttacgccgtaaggggtcggttacgacggggtaacncgttaacttcgacttccgtaanacgtactactacgcgtacgagtcgacgtaccgtagtaacgtacgttacgtacggtacgttacggttaacttaccgttagtaccgtaacgtacgtaagtttaacggtacggttaacgtttacccgttaccgtttacgggttaccggtttaccggttaccgggttaaacccgaaaggggttaaccccggttaaaaagggttaacggttaaaaccgggttaaaccgtaaacgggtaacccgtttagggttaaccggttaccggtaaccggtacctacggttaacgtttcccgttaacgg

SEQ ID NO: 146756 - DNA, 716 bp, Homo sapiens
  misc_feature: GYAE6OF02FVKPN.21.4.A04.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
tcagtcgtcgctcgcacgaccggtgctcgatttagagtagtgatcaggggagcctctgagagcggagccccagccccagaacttcccgaggtgttttcatttggtgatcagcactgaacacagaggactcaccatggagtttggctgagcgtgggttttccttgttgttatttacaaggtgtccagtgtgaggtgcagctggtggagtcgtgggganacgttggtccagccgtggacgggtcccngagacctcttccgtgtacgcacggccttcgtgctattcctacctttgacgtcgaaccacgaaactagtcggaccgttcgggccgtaccgaggcctaccggaagggagggtcctagggtacggtcgggttcggtaccgttacgttaacgaaacgggtaaactaccgtaaactagtttaacgacgttaacaagtaagtaccggcgtcgtacgtagtaaggaaacggtaacggttaccgaccgtagtacgtaacaagtaacgtagtagtagttaacgaaacgttaacctacgaacgttacgtataccgtacgaaccttaaagtacgaaaccgtacggtaacccgtaacggtaaaaccggacggaaaccgtaccgggtacccgttagttacgttaagttcgggtaacggttaacgaaagttaaacggtacgtaggtaacgttggttacggtaggtacggttacgtacggtaaccg

SEQ ID NO: 146757 - DNA, 756 bp, Homo sapiens
  misc_feature: GYAE6OF02GE3JZ.21.4.A04.1.454.CMB.1.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcacgaaaccaccggagaaattgtgttgacgcagtctccaggccaccctgttctttgtcctaccgaggggaanacgcctaccctctcctgcacncctcagccaagaactactccgaagacgtacctacctaacactacgcccgttacggtaacccagacaaggaaccgtccgtacggacccgtaacggcccttacccgtacggtttcccacgtacttctagtcgtccgtccgggtcccacgacggcctacgcggtccaccgtacccaaggtaccgaggttaccgaggtggccgtagggtcgggttacggtacgggtaacctacggttaccttaccgtaccgttctacacttacgtaacgttacgaacacggttacggtacggacggtaccttaaggtaacggttcgtttacggacgttagtttacgtttaacttacgtcgttacggtagttacgtaggttacgtaacggttaccgtttccgttaccgttacgtttcggttacccggttaccggtaacccggttaacggggaaccggttaaaggtaaacgtaaacggttaacggtaaaacgttacggtacggtacgtaccggttaccgacccgtacgttacgttccgtttaacg

SEQ ID NO: 146758 - DNA, 704 bp, Homo sapiens
  misc_feature: GYAE6OF02JJ53N.21.4.A04.1.454.CMB.1.raw
  modified_base (151)..(151): a, c, t, g, unknown or other
  misc_feature (151)..(151): n is a, c, g, or t
  modified_base (201)..(201): a, c, t, g, unknown or other
  misc_feature (201)..(201): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcacgaaaccgaccgganaaattgtgttgacgcagtctccaggcacctgtctttgctccgaagggaancgccaccgtctcctgcagccncanccagaatactccagagactactacatacgccgtaggtacagacagaacgccgtggacccacggtcctcccgtaggtttaccctcactaccgtagtcgtaccgtaccggtacccaacgacggtaccacgttcggccaacctccgaagtccgtacggtacaagggtgaccgtaggtttcgggcgtacgggctaacgggtacttaccgacgtctacgacgttactagttacgaacgtaggtaccggtaggacgtccgtaagttaacgtaactttacggtaccgtatttacggtactttacgtacggtaacgtacgtacgttaaggtacgtttacgtaacgttacccgtgttaaccgttcggttaaccgtaccgggtaaccgaagggtaaacccgttaagggtaaactaaacggtaacggtaaaacccgttaggtacgggttacgtacgtacccgtaacggtacccgttacttaacggttccg

SEQ ID NO: 146759 - DNA, 796 bp, Homo sapiens
  misc_feature: GYAE6OF02FN3DO.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccaggcaccctgtctttgtctccgaggggaaagactcccacctctcctgcagcctccagcccaagaactacgtccaagagacctactaacatacgccgtggtaacccagacaagaacgccgttcggacccgacggcctaccccgtacggtttccctacgacttacgtattcggtcccgttcgggttacccccaacggtacggggtacccctaacggtcgggacctaccgttaccccgaaggtaccgttacgggttaccgagggtcggcgtaacgggttggggttccgtacgggggaacctaacggttaccctttaccgaccctttaccgtactaacgttaccgttaagtttacggaaccgtaacgggaaccgttacgggtaaccgtaccgttaaacggtaacgttacgttttaccggtacgtaggtttaacgtttaacttaacgttacggttaacgtagtacggttaagttaacggttaggttaacgttaccgtaccgttacgttacggttaccgggttaccgaaccggtaacgggtacgtaaacggtaaaggtaaacgtaacggtaaacggtaacgttacggttacggtaccgtacggtaaccgtaaccgtacgttccggtttacg

SEQ ID NO: 146760 - DNA, 858 bp, Homo sapiens
  misc_feature: GYAE6OF02JA5BA.21.4.A04.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagtaaattgtgttgacgcagtctccaggccaccctgtcttgctcgagggaangccacctctccngcagctccagccaagaactactccagacncctaactacaactacgacctaggtaacccagaccgtaaggaacgtccgtacggaccgacggtcccttaccccgtaacgggtttcccaactaaccgttccttaacgtcggaacccgggttccgggtacccccgaacggaccggggtaccctaacggtccgggaccttacgaccgtaaaccgacggtaaaccgtacggggttaccgtaaggttacgggaccgttaacggggttcggggttaaccgtacggggggtaacctaacggtacccgtttaaccggacccgtttaccttaacggtaacttaccgtaaaggtttaccgacgtaacggttaaccggttacgggtaaacggttacccggttaaggtaaacggtttacgtttccggaacgttaggtttaacggttaaacgtttaccggtaaccggtagtaaccggttaacggtacggtttaacggttaagggttaacgttacccgggttaaccttccggtttacgggttacccgggttaccgggtaacccgttaaacggggtaaccgttaaacgggttaacgaaaacggtaaccggttaaacgtacgggttacgtacgggtaccgtacggtaacctacccgtgttacccg

SEQ ID NO: 146761 - DNA, 800 bp, Homo sapiens
  misc_feature: GYAE6OF02HV298.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaancgccaccctctcctgcagcctcaggccaagaactactaccagagctactacatacgcctagggtaccaagcaaggaacgtccgtggcccaagggtcccttacccctagggtttcccctacgaatttccgttaagtcggtcccggttaccgggggtacccccaacggaccgggggtaccccctaaggtccgggaccttaaaccgtcccccgaaacggtaccggttaaagggtttccccaaggggtttcggggaccgtaagggggttcggggttaccggtagggggtaacctaacgggttaccctttcgaacccgtttctccgtataaccgtagtttaacgctaacgggtaccgtgggtaaccgtaccgtaagggtaaacggttcgttttaccggacgtttaacgggttcgtttaacgtttacgttacggttaaccgtaacggtaccggttaaggttaggttacgggttaaactttcccgttacgttccgtttagggtcccggtttacggacccggaaggggtaacccgtaagggtaacgtaaacgttaacggaaacggtacgtggtacggaccgtgtaacccgacttacgttcgttaccg

SEQ ID NO: 146762 - DNA, 723 bp, Homo sapiens
  misc_feature: GYAE6OF02I18DH.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttggctgagcttgggtttccttgttgttattttacgaaggtgtccagtgtgaggtgcagcgtggtggaggtcgtggggggagtacgttggtccgaggccgtgggtacgggtcccctggagtacctctccgtgtcgcagccctgtcgctacttccaccgttcacggtacgaacccaaccaactagtacggaccgtcggggtccgccgacggtccgtaccggaggggaaggggtccgtgggacgggttcgggtaccgggtacccgttaagtaaccggaaggaaacgtacgtaaacgtacgttaacgaagtaaccgaaggtaaacgtaccgggacgtcggtacgttagggtaacggtaaagggtacggttaccaaccgtacttaccgtaacgaaaggagtacgtagtaacttaacgaaaacgtacttaccgacgttacgtacgttcgtagtaacgtaaagtacgaacgtacgtaaccgtaaacggaaaccgaaggtaaaccggaccggtccgttaagtactttaggttaggtaggtaagaacgtaaaggtacgtaggttagtaggttaggtggtacgtacgtggtaacg

SEQ ID NO: 146763 - DNA, 757 bp, Homo sapiens
  misc_feature: GYAE6OF02HGO35.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctctcctctgctactctggctcccaggctcagaaaccaccggagaaacttgtgttgacgcagtctcaggcacctgtcttgtctccgaaggggaacgcgccctaccctctaccgtgcacggtctaccgagacccaaagtaacttacgtccaaggtcgaccttaactactacgtacgtccttacggtaaccgagaccgtaagaacgtccgtaggccgacggtcccttaccgacggttaccactactcgttacggtcggtcccggtcgggacccctaacgggaccgggtacctaccggtggacctacgtacccgaacggtacgtaacggttcaacggtccggtgtaacgggttcgggtactaggggaccctaacggtcccttacgacgttccgtacaacgttcgtatacggactagtacgtggtctacgtcgtaaacgtcgttacgaacttaggttacttacgtaacgttcgtaccggtacgtaacggtaacgtacggttaaccgtacgttacccgtccgtttacggtaccggtttaccgggtaccgtaacggtaaccggtaaacgggttaacggaaacggttaaacaaccgggtaaacgtttaccggtggttaccgacggttaaccgtacccggtaaccttacgtaccggtttaccg

SEQ ID NO: 146764 - DNA, 705 bp, Homo sapiens
  misc_feature: GYAE6OF02H5YUL.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggaagaaattgtgttgacgcagtctccaggcaccctgtctttgtctcgaggggaancgccacctctcctgcacgctccacgccaagaatactccagacgctactacatacgcctggaccagcagaacgcctggccgaggcctcccgtacggttccctaccgtaattcctaagtcgccgttccgggtacccaacggacgggtcccacggtcggacctaaccgtacccgaaggtacgtacggtttccgaggtcgggacgtagggtttcggggtacgtacggggtaaccgtagtacccgtttaccgtaccgttacctacgactttacgtaacgtacgacgtacggacgtaggaccgtacgtaacggtaaggttacgtttccggacgttaaggtttacgtttaacttacgtgtacgtagtacgtaagttacggttagtacttaccgtacttcggttacggtccggttaccggaaccgtacggggtaacgtaagggtaaacgtaacgttaacgggaaaccttaaggtcggtacggtactaccggacctaacgttcgtacgttaccg

SEQ ID NO: 146765 - DNA, 666 bp, Homo sapiens
  misc_feature: GYAE6OF02JZ8LP.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaattgtgttgacgcagtctccaggctaccctgtctttgtcctccgaaggggaancgcctacccgtctcctgcacgcctaccgacgccaagtaatacgtaccaagtacgtctaacacatacgccttaggaccagcaagacgtccgtaggccgaggcctacccgtagttcctcatccgtagcgcgtccggtacccacggtacggcctaggtcgacctacgtcccgagtaccgtcggttacagggtcggactagggttgggtactgggaactacgtaccttacacgtcctacgataccgtagtacgcgaggtacgtgacgtactagagtacttcgacgtgttacgtacttagcgttacagtacgtacggttaggtaccgttaacgttccgtaccgtttacggttacgtccggttaaccggaccgtaacgggtaaaccgtaagggttaacgtaaacgttaacggaaacgtacgtttcgggacgtaccgggtactaacccgtaccggttacgttaccgttaccg

SEQ ID NO: 146766 - DNA, 826 bp, Homo sapiens
  misc_feature: GYAE6OF02J0FT6.21.4.A04.1.454.CMB.1.raw
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcacatggagttgggctgagcgttgggttttccttgttgtttattttacaaggtgtccagtgtggaggtgcagcgtgggtggtaggtcggtgggggacgtacgttcggtccgagcccggtaggacgggtccctgacgactcgtctgngcacgtccnctgcattccaaccttcaggtnaaccactaacgagtcggacgtcggtccncgaggctccggaaggggacgggtcgtagggacggttcggggtacggtccgtaagtaaacggaaacggaaagttacgtaacggtaccgttaacgaacgtaacgaacgtaaaggtacccggtaccgtacgggtacgtagggttaacggtaaacgggtaacgggtacctaaccgggtaattcccggtaaagtaaggagttaacgtcggtaaacttaaacggtaaaagaaacccgttaccgtaaattggttaactcgtaaacgtaaacggttaaacacgggttaaaacccgaccgttaaacccggtaaaacgggttaaaaccccgggaacgggtaacccgtaaaccggggttaccgtttaaaggtttacggtttaagggtttaaccgggtaaaggggttaaaccgtaaaaggggttaaaacggacgggttttaggggtaaaggttttcggggtaaaacggggtttaaggttaaccggggtttgggttaaccggttaaccgg

SEQ ID NO: 146767 - DNA, 836 bp, Homo sapiens
  misc_feature: GYAE6OF02I2VNQ.21.4.A04.1.454.CMB.1.raw
tcagtcgtcgctcgcacgaccggtgctcgatttagagtagtgatcagggggagagctgctcagttaggacccagagggaaccatcggaaaccccagcgcagcttctcttcctctgctactctgctcccaggctcagaaaccaccggagaaattgtgttgacgcagtctaccgaggcaccctgttctttgtctcgaaggggaacacgccaccctctcctgcacgctccacgccaagtaactacgtaccgacggactactaactaacacgtacggtccttagggtaaccagaccgaagtaaccgcccgttacgggaccgacggtcccttacccggtaacggtttccacgtactacttacggtcgaccgttaccgggtcccaacgggtacgggaccctacgtacggtacctaaccgttacccgaacggtaacgtacgggttaccgtacgggtacggacggttaacggggtttcggggtacgtaacggggacccgtaacgttacccttacgtaccgttacctactaacgtcgttaacgtaacggtacgtaacggtacgtacgggttaccgtaccgttaaagggtaaccgttacggtttccgaacgttaggttaaccgttactttacgtacgtaccggtaagttaaccggttaggttaacgtaccgggttaacgttccctaccgtttacggttaccgggttaccgtaaccggtaacccgggtaacgggtaaacccgttaagggtaaacgtaaacggtaaccgggtaaaacccgttagggttacccgggttacgacccggttaccggaacccgtttaaccgttacgttcccggttttaaccg

SEQ ID NO: 146768 - DNA, 847 bp, Homo sapiens
  misc_feature: GYAE6OF02JZ7AU.21.4.A04.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (622)..(622): a, c, t, g, unknown or other
  misc_feature (622)..(622): n is a, c, g, or t
tcagtcgtcgctcgcacgaccggtgctcgatttagagtagtgatcaggggagctctgagagcggagccccagccccagaattcccaggtgtttcatttggtgatcagcactgagcacagacggactcaccatggaactgggctcgagtcgttcgggtttccttggttgttattttagaaggtntccgagtgtgaggtgctagctacggtggagtcgtggggagtctggtccaggtccgtcggggtcccngacgagtctctgtgtcggcctcgnggtacttactaagtttatacccgttagttcggtagtagtaggtccgttcgggggtacccctaccggtaggtacccttccggtaaaggggggtaccggggtaccttagggggtaagggttggggcccgggtaaacctaacggtaaacggttaaaacgggtaacgggttacgttaaacggtaaaggttaaaccgtaaaaccggtaaaagttaaccggtttggtaacgggtacttaccggtaggttaacggaacggggtacctaactttaccgaccgttagttccctacggaacggtaccgaaccgtacggaccttaaacggaaccttctaaaacgtttcacggtactaaanaaggttaacgtacgttaccgaaaccgtgggtaaaccggtacgtaaccggtaaaccgggtacttacccgggtaaagtttcgggttaaaccccgttagttttaacccggtcggtaacgaacgggtaaacgtaaccggggtttagggaacccctttacgggggaaaccggttggggttacccccggtaaagcggtaaacccggtttccggggttaactttaaccgggg

SEQ ID NO: 146769 - DNA, 810 bp, Homo sapiens
  misc_feature: GYAE6OF02IXIFZ.21.4.A04.1.454.CMB.1.raw
  modified_base (209)..(209): a, c, t, g, unknown or other
  misc_feature (209)..(209): n is a, c, g, or t
  modified_base (459)..(459): a, c, t, g, unknown or other
  misc_feature (459)..(459): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcacgaaaccaccggagtaattgtgttgacgcagtctccgaggccaccttgtctttcgtccgtccggaaggggtaaanacgtccctaaccctcttccgtggactacgtccttacccgaggtacccaaggtaactaccgttacccgaaggaacgtaccttaaccgttaagacttaacgggcccgttacgggtaaacccaggtaccgaaaggttaacggccccgttagggacccaagggttccccttaccccgtaaggtttccctacgtaacttccgtaagtcgtccgtacgggtaccccaggtaccgggtacctacggtcgccgtaacnccggtaagtacgtacggtgacgtgacgtaggtcggtgtacggacacgttacctcgtactccgtataaccgtagtacgttagacccgaagtcgtaaggtccgtacgtaacggtaacgtttacgtaccggcgttaaggtacgttacgtttacgtaggtaccgacggtaccgttaaggtaacggttaccgggttaaacttaccgttaaccgttccgggttacgtttacccggggtaacggttacccggtaaagtttaaccggtaaacgggtttaataaacgggttccgaaacgttttaacggcggtttaaccggtcgtaaaccgttcccgaacggtttagtaccgttttaaccg

SEQ ID NO: 146770 - DNA, 980 bp, Homo sapiens
  misc_feature: GYAE6OF02GSKS5.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcagctggtggagtcggtgggggagtacgttggtccagccgtgggacggtccctggacgtacctccgtccgtgtgccacgtccgtctgctattccctacccttacacggttacaacccaaccaaacctagttacgggaccggttacgggtccccggccgaacggggtccctacccgggaaggggggaaacgggggtccgttagggggtaacggggttcgggggtacccggggtacccggttaaacgttaaaccgggaaaagggtaaacgtaaccgttaaaaccgttaagggtttaacccaaggttaaaccgaaaggtaaacgtaccggggtaccggtccggttacggtacgggtaaacgggtaaaaggggtaacccggtttaccccgaaacccgttaacgttacggtaaaccggaaaagggtcgttaaagttacggttaaaacgttaaacccgaaaaaacgttacccgttaccgttaaaccgtttggtttaacctcgttaaaccgggaacgtaaaaaagtttcccggaaaaaccgtaaccgtaacccccgtaaaaacggggtaaaaaacccggtccgggggaaaccccttaacccggggggttaccgtttaagggttttttaaacccgtttagggggtttaaaccgggttaaacggggttaaaaaaccgggtaaaaccgggtaaaaaaggggttttccggggtaaggttaaaccggggtttttagggggtttaacccggggtttaaacgggggttcccttaacgggggttttacggtaaaaccccggg

SEQ ID NO: 146771 - DNA, 746 bp, Homo sapiens
  misc_feature: GYAE6OF02FE9Q0.21.4.A04.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagagtagtgatcaggggagctctgagagcggagcccccagcccccagaattcccaggtgttttcatttggtgatcagcactgaacacagaggactcaccatggagtttgggctgagcttgggtttttccttgttgttatttacgaaggtgtccagtgtgaggtgcagctggtggagtcggtgggggagacttcgggtccagccgtggacgggtccctggagactctcctgtcgcacgtcctctgctacttctaccctttgagtcgaaccacaacngttacggacgtcgggtcccgaccgtacggcctacggaagggggaacggggtcgtaggggtacgggtcggggtccggtaccggttaataaaccgggaaggtaaagtacctaaacgacggtttaaccgaacgtaacggtaagaaacgttaccggggaccgttacggtccttagggtaaggaaacgggtaagttaccaacccgtataccgtaacgaaagacgtaagtacgtaactacgaaaagacctactattacgtataccgtagaactaaacgtacgaaacttaacggaccttaaacggaacccggaacgtaccgggaaccggttaccgtaaggtttaacgttacgggtttggttaaaccggggttaaaaaacccgggtaaaaggtccggttaagggtacgttagggttacgggtagtaccggtggtttacggtaacgg

SEQ ID NO: 146772 - DNA, 763 bp, Homo sapiens
  misc_feature: GYAE6OF02GONGJ.21.4.A04.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcaagaaaccaccggagaaattgtgttgacgcagtctaccgaggcctaccctgttctttcgtcctaccgaaggggaaacncgacccacccttctccncgacacgccgtacacgccaagtaactactaccgagacgtactaacgtacagtacgaccgttacggtaccagacgaacggaacgtccgaggaccgacggtccttacccggtacggttccctacacttactacgtcggccgttaccgggaccacggtaccgggtacctacggttcggacccacttaaccgacggttaacgtacggtttaccagggttcgggtaccgtaggggtttcggtacgggtacggaaaccttacgggttaaccctttccgtaaccggtttcgaacctacttacgtaacgtttacgaaccgtaacggtacgtacgggtacgtacgtaacggtacgttacgttcgtacgtagttacgttacgtacgtacgtacgaacgtacgtacgttagtacgttaacgttccgtacgttacgttcggttaccggtacgggaaccgtacgggtaagtaaccgggtaaaggtaaactaaccggtaaagttacgttcggaacgtcgtaacgtacctacttaccggtacttaccg

SEQ ID NO: 146773 - DNA, 698 bp, Homo sapiens
  misc_feature: GYAE6OF02HH6WI.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaaggggtaaagacgccctacccgtctcctgccagcctaccgagccaagtaactactacccagaacgctaactaacatacgccgtacggtaccagactaagaacgtccgtacggaccgaggcctacccgtacggttacctacacttactacgtcgtcgtacggtccacgacggaccacgtcgctttttacacccgtagacgtacggttcgtacggtcggacgtacggtcggtacggtacgggtaactaacgtaccgttaccgtacctacgttactactacgtaagttacgacgtaacgtacggtaggtacgtacgtaagtaagtacgttacgtacgttagttacgttaacttacgtacgtacgtacgtacgtaagttacgtacgtacgttacgtaccgttacgttacggttaccggtacgtaaccggtacggtaacgtaaggtaacgtaaacgtaggaaacgtacgttacggtacggtacgtacgtaccgtaacgtacgtacgttacg

SEQ ID NO: 146774 - DNA, 689 bp, Homo sapiens
  misc_feature: GYAE6OF02HRNHR.21.4.A04.1.454.CMB.1.raw
  modified_base (125)..(125): a, c, t, g, unknown or other
  misc_feature (125)..(125): n is a, c, g, or t
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcncccttaggctcagaaaccaccggagaaattgtgttgacgcagtctcgaggcacctgtctttgctccgaggggaancgccacctctctgcacgctccgacgaccagaactatccagacgtactactacagtacgccttacggtaccagacaaggaacgtccgtcgggaccgacggtcccgttaccccgtacgggtttccctacgtacttccgtaacgtcgggtccgttaccggggtaccccacggaaccgggtcccctacggtcggacctacgttacccggaagtacgtacggttccgaggtcggacgtagggttcgggtacgtacggggactacggtacttaccacgttcgtacctacttacgtaacgttacgacgtagtaacggtggaccgtacgtaggtaacgtcgtttaccgagttaggttaacgttacgttacgtcgacgtaacgtcgtaaggttacgtacggtacgttaccgtacttcggtcgtcgttacggaccgtacggtacgaaggtaagtaacgtacgaacgtacgtagtcgactacgacctacgtactgttacg

SEQ ID NO: 146775 - DNA, 892 bp, Homo sapiens
  misc_feature: GYAE6OF02FZGG6.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgttgggttttccttgttgttattttacaaggtgtccagtgtgaggtgcgagcgtggtggagtcggtagggggagtacgttgggtcccaggtccgttggggtaacgggttccccttaggacggtaccctccgtccgtgtacggcaacggtccttcgtggtactactttcctaaccgtttcgaagtcggaacccaactaaccgtaggtacgggtaccgttcggggtaccccgcccggtaggtaccgtaccgggaacggggacgggtccgtggggtacggtcggggtccggtaccgtagtaacggaaacggtaacgtacaaccgttacggtaaccgtaaggaccgaagtaacgggtaccggcgttacggtacttaacgggtaagtaaaccggggttaccttacgaacccgttacgtaccgttaacgtaacgggagtaacgttaggtaaaccttaaacgtaaaacgtaccgttaccgtttaaacggttacgttaaccgtaccggtaaacgaaaccgtttaaaacggacccgtaaaacgtaacccgtaaacgtaaaacccgggaaaaacggggttccgaaacggtaaccccggttaaccgttaagggttttattaacggggttaacggtttacggggtaaaaacccggttaaaaaggtaaaaccggggttttagaaacggggttagggttttaccggggttaacggggttacggttaacccgggtttagggtttaacccggtaaccggg

SEQ ID NO: 146776 - DNA, 809 bp, Homo sapiens
  misc_feature: GYAE6OF02FSKRS.21.4.A04.1.454.CMB.1.raw
  modified_base (148)..(148): a, c, t, g, unknown or other
  misc_feature (148)..(148): n is a, c, g, or t
  modified_base (208)..(208): a, c, t, g, unknown or other
  misc_feature (208)..(208): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctccaggctcagaaaccaccgganaaattgtgttgacgcagtcctccgaggccaccctgttctttcgtcctccgaaggggaacncgcccacctctcctgcagcctccacgaccaagaactactccgagacgtactacgtacactacgtccgtagtaacccagacctaaggaacgtccgtacggaccggacggtcccttacccggtaggttccctactacgttaccgttagtccggtaccggtccgggtacccacgggaccgggtaccctaaggtccggacctacgtaccccgaaggaccggtacggtttaccgacgggtcggaacgttacggggtgggtacggtacgggtaactcggttaccttcgtaaccttcgtacctagttacctaagtacgacgtaacggtacggttacggaccgtaccgtagggtaacttaccgttagaccgttaaggttttacggttaaccgttacgttccggtaacgtacggtaacgttaacgggttacggtaacggtttaaaccgtttcccgttacgtttccggtttcgggtaacccggttaccgggaacccgtaacggggtaacccgttaaaaggggtttaaaccggtaaaccggttaaacgggtaaaacccgtttaggcgggtttaaccggcgttaccgaaccgtaccgttagttccgtttaccg

SEQ ID NO: 146777 - DNA, 815 bp, Homo sapiens
  misc_feature: GYAE6OF02INPEA.21.4.A04.1.454.CMB.1.raw
  modified_base (675)..(675): a, c, t, g, unknown or other
  misc_feature (675)..(675): n is a, c, g, or t
tcagtcgtcgctcgcacgaccggtgctcgatttagagtagtgatcaggggagctctgagagcggagccccagcccccagaattccccaggtgttttcatttggtgatcagcactgaacacagaggactcaccatggtgtttggctgagtcgttcggttttcttgtttgtttatttacgaggttcgtcgagtgtgaggtcgcgagtcgttggtggtagtcggtagggggtacgtacgtttcggtaccgacgtccgtagggtccgggtcccgtaggaacgtaccttcgttccgttgtcgacgtacgtcccttcgtcgtacttacgttccttaccgttcgtacgttaccgaaccctaaccaacgtagtacggaccggttccgggtaccccgaccggtaccggtccgtaccgggtagggggaaccgggtcgtacggggtacgggttcgggtacccggtacgttaacgtaacggaacggtaaacgttaaccgtaaacgtaacggttaacgtaacgtaacgtaaggtaacggtaccggtaccgtacgttacgtagggtaacggtaaacgggttaacgtccaacgttcgtactaacgaaaggtaacgtagttacgtaacgttaaacccgaaagttaaccttacgttacgttacggttaactccgaattaacgtaaacgtaanaccggtaccaacggtaaacgaaccgaacggtacccgtaggttaccgttagttacgtttgtacgggaactaaaccgtaaaggttaacggcgttaacggtaggttacgggttgtttaaacggtcgtcgggttacgtaaccgg

SEQ ID NO: 146778 - DNA, 779 bp, Homo sapiens
  misc_feature: GYAE6OF02G1WW5.21.4.A04.1.454.CMB.1.raw
  modified_base (118)..(118): a, c, t, g, unknown or other
  misc_feature (118)..(118): n is a, c, g, or t
  modified_base (288)..(288): a, c, t, g, unknown or other
  misc_feature (288)..(288): n is a, c, g, or t
  modified_base (733)..(733): a, c, t, g, unknown or other
  misc_feature (733)..(733): n is a, c, g, or t
  modified_base (766)..(766): a, c, t, g, unknown or other
  misc_feature (766)..(766): n is a, c, g, or t
tcagtcgtcgctcgcacgaccggtgctcgatttagagtagtgatcaggggagctctgagagcggagccccagccccagaattcccaggtgttttcatttggtgatcagcactgaacanagaggactcaccatggtagtttgggctgagtcttgggttttccttgtttgttattttacgaaggtcgtcctagtgtgaggtgcgaggtctgggtggagtcggtgggggagtaccgttggtaccaggtccgtagggtacggtcccgtaggacggtacttccgtccgttagnggtcgaaccgcccgttcgtgtaccagttaccctaccttcgaagttcgaaccaacaacgagtacggtaacgtcggtccccgccgtaaggacccgttaaccggaaggggaaccggggtgtacgggggtagttcggggtaccggtaacgtacgtaaacggtaaacggaaaacgtacgttaaacgtaacgtttaacgtaaacggtaactaaagggaaacgttaaccgggacgtacgttacgtaggttaaacgggtaaagggaacgttaacccgtaaacgtaacgttacgtaaacgaaacgaagttaagtacgttaaacgttaaacgtaaaagtaaccttacgtaaacgttagttaactaacgttgaaaccgtaagtaacgaaactaacgtaccgaacgaaacgacgtaacgaaccgacgttacgtagttactagggtaagtaacgaaanaaacggtgtaaggtagtccggttaggtaaggtntacggttagtaac

SEQ ID NO: 146779 - DNA, 799 bp, Homo sapiens
  misc_feature: GYAE6OF02HFI8I.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctaccgagggaagacgccaccctctcctgcacgcctccagccagaatactccagagctaactacatacgcctaggtaccagcagaagccgtggacccaggcctacccgtacggttcctacactctagtcgtccgtcgggccccacggacgggccctacgtcggacctaccgtcccaacgtaccgtaggttccgaggtcgggacgtagggttcgggtacgtacggggaactaacggttaccttaccgtacccgttcgttacctaacgttaccttaacggtttaacggaccgtaacggtaccggttacggggaacgtccggttaacggaacggtttacgtttaccggaacgttaacggtttacggtttaactttaccgttggtaccgtaacggttaccggtaaggtttaacggttacgggtaaccgttttacccgtaccgtttaccgggtttacggttcccgggtttaccgggaaacccggttaacggggtaacccggttaaaagggggtaaaccgttaaacgggttaaacggtaaaacccgggttaacgttacggggtaccgggttacggttaacccgtaacccgtaaacccggttactttaccggtttaccg

SEQ ID NO: 146780 - DNA, 826 bp, Homo sapiens
  misc_feature: GYAE6OF02HRD24.21.4.A04.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagagtagtgatcaggggagagctgctcagttaggacccagagggaaccatacggaaaccccagcgcagcttctcttcctctgctactctggctcccaggctcaacgaaccaaccggtagtaaattgtgttgacgctagtctaccgaggcctacctgttctttcgtaccgtacggaaggggaaagaccgacccacccttctccgtacggacctacggccttaccgacgaccaaggtaacttacgaccaaggtacgtacctaacctaactacgtaccgtaccgtaccggtaacacgacgaacggaacgtccgtacggaccgacgtacccgtaccgtacggttcctactactntacgtcgcgtccggaccacggacggtactacggtcgacctaccgtaccgaggtacgttaggtaccgtagggtcggacgtagggttacgggtcgtaacgggtacgtaacgttaccttacgttcccgtactacccgtaacgtaactacctaaccgaacgttaccggtccgtacccggtacgtaaacggtttaccggtttagttacgtacggtttaacgttaccgtttaaagttaccgtaacgtacgtaagttaaccgttagggtaacgtttacggggtaccgtttaaccggtaacccgtttaccgggttaccggttaacccgggtaaccgggttaaccgggaaccggttaggggtacggtaacgttacggaaccgttaacgggaaccggttaacggttcgggtaaccggtactaccggttaccctaccggtcgttaccgttacgg

SEQ ID NO: 146781 - DNA, 566 bp, Homo sapiens
  misc_feature: GYAE6OF02GA61A.21.4.A04.1.454.CMB.1.raw
  modified_base (195)..(195): a, c, t, g, unknown or other
  misc_feature (195)..(195): n is a, c, g, or t
  modified_base (343)..(343): a, c, t, g, unknown or other
  misc_feature (343)..(343): n is a, c, g, or t
  modified_base (544)..(544): a, c, t, g, unknown or other
  misc_feature (544)..(544): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggtgtcaccgggagaagttgtcttgacgcagtctccaggcaccctgtctctgtctccaggggaaangttactctctcctgcaaggccagtcagtagtgttggcatcgacgttgcctggtaaccaaacaaaacctggccaggcctcccagtcctcctcatctagtgggcatcctacgaggatcgaccggtcacgtcccagactaggttcaggtcncgtaggtggtcgaggtacacgtacttcactctacaaccactacaacacctacgtcggcgtactagaagttctttgacgtagttgtaatttacgtgtatagtattagtagtggtagtctaccgtacttaccgttacggaccgaacgggtacgtaagggtcgagtagtacgaagacgtaagcgtggctagactacgtatcgtnttcctacgtactcccgtccgtc

SEQ ID NO: 146782 - DNA, 858 bp, Homo sapiens
  misc_feature: GYAE6OF02I2YY7.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagttggctgagcgttgggtttccttgttgttatttacaaggtgtcagtgtgaggtgcagcgtggtggagtcgtgggggagtacgttggtcccgagtcccgtgggacgggttccccgtggaacgtacccgttcctcccgtggtcgacctacggccccttcgtgcctactttcccacccgtttacgaggttacaacccaaacaaaccgtagtagggtaacccggttcggggtaccccgcccggtaacgggcccgttaacccgggaaaggggggtaacgggggtccgttagggggtaacggggttccgggggtaccgggggtaccttaacggttaaacggaaaaacggtaaaacggtaaccgtaaacgtaacgttaaacgaacgttaaacggaaaggtaaacgtaaccggccgtacggttaccgtaggtaacgggtaaacgggtaacggttaccaacgtacgttacgtaccaaaggtaagtaacgttgtaaccgttaacgaaaacgttaacgtaccttaaacgttacgttaacgttaccgtacgaaaccgtaaaacgttaacgaaaaccgtaaccgtaaccgttaaaccgggaaaacccgaacgggtaaaccgtaacccgggtaccgttaaggtttagtttacggttacgggtaaagggttaacggaaaccggtaaaaggacggttaaggtagttaggttacgggtggttaacgtgtacggtaacgg

SEQ ID NO: 146783 - DNA, 515 bp, Homo sapiens
  misc_feature: GYAE6OF02FGCUK.21.4.A04.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (401)..(401): a, c, t, g, unknown or other
  misc_feature (401)..(401): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccacctntcctgcagcctccagccagaatatccagagctactacattagcctggtaccaacagaagcctggccaggctcccaggttcctcgatctatgctgggtcccagacgggccactggccatccccagacaggttcagtggcaggtggtctgggacagacttcactctcatcattagcagactggagcctagaacgtnttcgctagtgttattactgtcagcagtataggtaattcacctctgtcgttcgaccaagggaccaaggtagaaatagaaacgtacgtgtaggctacgaccacgtactctgttacc

SEQ ID NO: 146784 - DNA, 649 bp, Homo sapiens
  misc_feature: GYAE6OF02F5XXX.21.4.A04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctgggtggagtcgtggggggagacttgggtccaggccctgggacgggtccctgacgactctcctgtgcagcctctgccattcctaccttcagtcgaccacaacagtggacgtcgggtcccgcgaggccctacgaggggaacggggctagggngggttcggggtccggtaccgttagttaaccgaaagggaacgtactaacgtagttaaccagtaacagaacgtacggcgcgttactaggtacgaaaggtagttaccactactcacaagacgatagtataacgaaagtaactctactgttactcctaggaactaaagtagaacgtacgtaaccgtaacgaaaaccggacgaaccggaaccggtacgttagttacttaggttaggtaacggttaaggaacgtaaaaggtggtacggtaagttcgggtagggttaggtacgtcggttaggtaaccg

SEQ ID NO: 146785 - DNA, 885 bp, Homo sapiens
  misc_feature: GYAE6OF02HVEFG.21.4.A04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagtaaattgtgttgacgcagtctccgaggcacctgtcttgctcgagggaancgccacctntcctgcacgactccgaacggaccaaggtaactacgtaccgaaggacgtaccgttaaccttaacgaacgttaacggcccgttaacggggtacccaaaggaccgaacgggtaaaccggcccgttacgggacccctaacggggccctttaaccccgtaacggggtttcccctactaccttacgttaagtcggtacccgttccgggggttaaccccaaccggtacggggtaccctaacggtcgggtacctaaccgttaccccggaacggtaaccggttaacggtttaccgacggggtttacgggccttaagggggtttaccgggttacggtaacgggggtaaccttaacgggtaccctttaaccgggtaaccctttaccggttaccgaacgtttaccgtaaacggtttacggaacccgttaacgggtaaaccgttaggggtaacccgtaccggttaagggttaaccgtacggttttacgaaccggtttagttacggtttaacgtttacgtaccggtaagtacgtaaccgtaaggttaacgtacgggttaaccgttccgtaaccgtttccgtaagggtcccggtttaccgggaacccggttaacgggtaccggttaaaggtaacgtaaacgttaacggaacgttaacggtggtacggtacaccggttaaccactgtacttaccg

SEQ ID NO: 146786 - DNA, 850 bp, Homo sapiens
  misc_feature: GYAE6OF02HFT4S.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaagcgccaccctctcctgcagcctccagccaagaactactcccagacgcctaactacagtacgccgtacggtaacccagtaccaaggaacgcccgtgggaccccgacgggtcccttacccccggtagggtttcccctacgtacttaccttaagtcggtaccggttccggggtaccccaacgtacggggacccctacggttcggacccaaccgttcccccgaaggtaaccgtacggtttaccgacggtcgggacctaggggtttacggggtcggtaacggggacctaacggtaccctttaccgaccgttaccctacgttacgttaccgtaagttaccggtaaccgtaacggacgttaacggggaccgttaacccgttaaggtaaacgtttccggtttaccggacgttaacggtttacgtttaaaccgttttaccgtaggttaccgaacgggtaacgttaaacgggtttaacgttacggttaaccggtttaccctaacccgtttcgtttccgggttaacccggttacccgggtaaccgggtaaccgggtaaaccggtaaagggtaaaacgtaaaccggttaaacggtaaaacccgttaacgtacggggttacgtaccggttaaccgacccgtaaccggttcctaaccggtttccg

SEQ ID NO: 146787 - DNA, 246 bp, Homo sapiens
  misc_feature: GYAE6OF02HRXMW.21.4.A04.1.454.CMB.1.raw
  modified_base (197)..(197): a, c, t, g, unknown or other
  misc_feature (197)..(197): n is a, c, g, or t
  modified_base (230)..(246): a, c, t, g, unknown or other
  misc_feature (230)..(246): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtcagtgtgaggtgcagntggtggagtcgtgggggagtacttggtccaggnnnnnnnnnnnnnnnnn

SEQ ID NO: 146788 - DNA, 656 bp, Homo sapiens
  misc_feature: GYAE6OF02G9N54.21.4.A04.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgctccgagggaaanagccacctctcngcagctccagccagaaactataccgagacgctaacacagtacgccgtacggtaccagacagaacgcctggccaaggcctccacggttccttacgactctatcgcgtcgggtcccacggacgggccacgtggacacgtccaacgtacgtaaggttcgaggtcggcgaggttgggcgttagggactagtaccttacctaccgtcgtacatacctattacgactaacggaccgtggacgaccgttaggaagttacgttacggtaccgtaagttacgttaacgtttacgtacgttacgaagtaccgaagtttagtaacgggtaatttacccgacgtttcgttacggttaccggttacggtaccggtaacgggaacgttaacgggtaaagtaaacgtaaggaaacgtaacgttggtaacggtcgtacgacccgtaaccgtgttacgttacg

SEQ ID NO: 146789 - DNA, 811 bp, Homo sapiens
  misc_feature: GYAE6OF02IR2VX.21.4.A04.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtcagcctggaggtccctgagactctctggtgcacgcctntgcattccaccgttcagtgaacccacaactgtggacctggggtcccgaccagggtacctccggaagggggaacggggtctaggggaacgggttcggggtccgggaaccggtaacttaacggaaaagggtaaacgtaccgttaaacgacgtttaacgaacggtaacgtaacgaaacgttaccggggaccgtacgggttacctagggttaacgggaaaaacggggtaacggggtttacccaaaccctacgttacccgtaaacgtaaagggtaaccgtaaaggtaacggaacgttttaaaccgaaaacggtaaacctttaccaaccgggtttaacggttaacttaccgtaacggaaaccttaaagggttaaaccaaacccggaagtttaaccccggaaaggtaaaaccccgaaggggaaccgtaaacccgggtacccgttacgggtttaacgtttaggttaccggtaaggggtaaccgtaaacggtaaaagggtacggttaagggtaacggttcggggttaaggtacggggtttacgtaccggtaggtaccgg

SEQ ID NO: 146790 - DNA, 723 bp, Homo sapiens
  misc_feature: GYAE6OF02GQGL6.21.4.A04.1.454.CMB.1.raw
  modified_base (147)..(147): a, c, t, g, unknown or other
  misc_feature (147)..(147): n is a, c, g, or t
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctccaggctcagaaaccaccgganaaattgtgttagacgcagtcctcaggcaccctgtctttgctccgaaggggaaacncgcccaccctctcctgcacgcctccagccaagaactactaccaaggactactaactaacagtacgccgtaggtaaccagcaaggacgcctaggcccagggtcccttccggtaacggttccctagacttccgtagtcggtccgttccgggaccccaacggcgggccctaacgtcgggtaccaccgtacccgaaggtaccgttacggttcgacgggttcgacggtagggttcgggtacgtagggactagtacccgttcaaccgttcacgtactactaagttacgactaacggtacgtaggacgtaacgtagtaacggtacgttacgacgttacggttacgttacttacgtacgtaacggtacgtaacgtaggttaagtacggtaacgttccgttacgttcgttacggttccggtaaccggtaaccggtaagggtaaccggtaaggttaaacggtaaacggttaacggtaaaccggttacgtaccggttaggaccgttcgaacccgtacgtaccgttagtaccg

SEQ ID NO: 146791 - DNA, 773 bp, Homo sapiens
  misc_feature: GYAE6OF02FO8TE.21.4.A04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaangccaccctctcctgcagctccagccagaatactccagagctaactacgatagcctgtaccagcagaagcctggccaggcctcccgagttccnatctatgctggccccagacgggccacgtggcactcccgagaccgaggtttcaaggttcgggctagggtcgggtctacgggaacgtagtacctttaccgaccgttccgtacacgttacgtaacttacgaccgtaacggtaccggttagggtacgtacccgttaaggtaaaacggtaacgtttttaccgggaactagggtttaacgttaaacgtttaacggttacggttaccgtaacggtacttaacgggttaagttacggggttaaaagtttccccgtaaacccgtttcgtttacgggtttacccgggtttacccgggaacccggtaaaaccgggggtaaccgttaaaacgggggttaaaacggttaaaaacccggttaaacggggtaaaaaacccggttaaaccggtttacggggtttaaccggtacgggttaaccggtaaacccgtaaaccccggttacggttacccgttttaaccccgg

SEQ ID NO: 146792 - DNA, 807 bp, Homo sapiens
  misc_feature: GYAE6OF02F70C8.21.4.A04.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagccacctctcctgccagcctccagccaagaatanccagacgtctactacatacgccttaggtaccagcaagaacgcctcggaccagggtccttaccccagggtttcccncgtacttactaacgtcggtcgttcggggtaccccaacgaggggacccaccgttgggaccacgttacccgaaggtaacccaggtttccaaagggttcggcgtaacgggttggggttacccgtagggtaaaccgagtaacccgtttcgaaaccgtttccacgtaatactaaacgtttacggacctaacggaaccgttacgggacgtacccgttaagggaaacgtaacggttttaccgaccgttaagggtttacgttaaacgtttaccgtacggttaaccaacggtaaccgtaacggttaaggtacgggtttaaacggttccgtaaacccgttcgttacggttaccgggtttaccgggaacccggttaaacgggaacccggttaaaacgggtaaacggttaaaaaccggttaacgggtaaaaacccgttaaccggttaaggttaaccggtacggtttaaccggaaccgtaacccgttaaccgttaccggtttaaccgg

SEQ ID NO: 146793 - DNA, 666 bp, Homo sapiens
  misc_feature: GYAE6OF02GWMYE.21.4.A04.1.454.CMB.1.raw
  modified_base (214)..(214): a, c, t, g, unknown or other
  misc_feature (214)..(214): n is a, c, g, or t
  modified_base (468)..(468): a, c, t, g, unknown or other
  misc_feature (468)..(468): n is a, c, g, or t
  modified_base (518)..(518): a, c, t, g, unknown or other
  misc_feature (518)..(518): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttcctgttgttatttacaaggtgtccagtgtgaggtgcagctggtggagtcgtggggganacgttggtccagcctggacgggtccctgacgactctcctgtcgcagcctctgctattcaccttcagtcgaaccacaactatgggaccgtcgggtccgccgagggcctaccggaagggggaacggggtcgtgggaggttcggggtacggaccgtaagttaaccgaaagggaaacgtcctaaacgaggtttaacgagtaacgagtaaacgtacgggcgtcgtactggtagaaagggtacgttccaactatacgtanaaacgagtagtacgtaacttaacaaaagtactcgtaactgtaatccgtanaactaaaggtacaaccgacggtaccgtaaacgggaaaacccgtacggaaaccgtaccgggtaccgttaagttacttaggttcggttaaggtaacgaaaactaaagggtgtaggtagtcggttagggtagttaggtaccgtggtaaccg

SEQ ID NO: 146794 - DNA, 656 bp, Homo sapiens
  misc_feature: GYAE6OF02HE8KZ.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaaancgccacctctcctgcagcctccagcccaagaaactctccaagacgtctaactacagtacgccttggtaccagcagaacgcctggccaggcctcccgaggtttcctcatccttatcgcgtcgggtaccccacgacggggcccacgtcggctacctccccgagacgtacggtttccgaggtcgacctagggttgggtcgtcggggactacggtactttccacttctcatccagtttacgcgtacgacgttggacgccgtagtaacgtactttcggactagttagttaacgttacttcggtacacgtacgtagttagtacgggttaacttcgaaccgtttcgttacgttccggtttaccggaccggtaacgggtaacccgtaaagggttaactaaacgtacgggtaaaaccgttacgttacgggttacgggccttaggaccctacgtacgttccgttcgg

SEQ ID NO: 146795 - DNA, 871 bp, Homo sapiens
  misc_feature: GYAE6OF02JI10I.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtcctccaggcaccctgtctttcgtctccgaaggggaaagacgcccaccctctccgtgacacgtctaccagaccagaaatactccagacgctaactacaatacgaccttaaggtaccagacgaggtaacgcctaggccaaggtcctacccctaacggtttcccacgaacttaccttaagtcgtaccggttacgggttacccccgaaacggacggggtacccctaacgtcgggaccctaaccggttaccccgaacggtaaacgttaacgggtttacccaaggggtttcgggacccgttaagggtttgggggtaccggtacggggtaaaaccagggttaacccctttacgaaccgtttccgtttaaacacggttaacccttaagtttaacggacccgtaaacggtacccgggtacgggaaacgttaccgtacggttaaacggtaaccgttttacggacgtaaaggtttcgttaaactaaccggtttcaaccgtcgttaacctagggttaacgtaaccgggtttaaaccgttaccaaccccggtttgttaaccggttttaccccggggtaaccgggaaacccgggtaaccgggttaaaccgaaacggggtttaaacgtaaaacgttaaccggggaaaacggttaacggtttacggggtaccggaacttttaccgggaacccaacccgttttacggttactttacccggg

SEQ ID NO: 146796 - DNA, 747 bp, Homo sapiens
  misc_feature: GYAE6OF02F49CF.21.4.A04.1.454.CMB.1.raw
  modified_base (195)..(195): a, c, t, g, unknown or other
  misc_feature (195)..(195): n is a, c, g, or t
  modified_base (640)..(640): a, c, t, g, unknown or other
  misc_feature (640)..(640): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcacctgtctttgctcgagggaanactccacctctcctgcacgcctccacgtaccaagaactactaccgaagacgtccttaaccactaatacggcccttgggaacccagccgaagtaacgcccgtgggacccgtaaggccccttacccgtaagggttccccttacgaacgtttcctaacgttcggtcccgttacggggttacccccaacggaccggggtaccctaaccgttcgggtccaaccggtttaccccgaacggtaacccgtacgggtttacctaggggttcggtacgtaacgggtttcggggtaccggtttacggggaaaacccttcggtttaaacccgttccgtaacgttacccgttaccgtacttacgtaacgtttcgacgtaacggtcgtacgggtaccgtcgttaggaacttacgtttacggagtacgttacgttacttacgttagtacgtacgttacgngttagtacggttacgtctaccttcgtccgttacgtcgtacgtacggacctaaggtacggaaatacggaaacctgtagtacggtcgtacactacgtacgttgttaccg

SEQ ID NO: 146797 - DNA, 701 bp, Homo sapiens
  misc_feature: GYAE6OF02H34G9.21.4.A04.1.454.CMB.1.raw
  modified_base (182)..(182): a, c, t, g, unknown or other
  misc_feature (182)..(182): n is a, c, g, or t
  modified_base (221)..(221): a, c, t, g, unknown or other
  misc_feature (221)..(221): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatgtagtttgggctgagcgttgggttttccttgttgttaattttacaaggtntccgagtgtgaggtgcagcgtggtggagtcgtggggganacgttggccagccgtgggacggtccctggacgtactcctctgtagcgacgcctctgcctacttcgtaccttcagtacgaccaactacgatcgggaccgtcgggtccgacctacgggcctccggaaggggaaggggcctaggggtacggtcgggtaccggtccggttaattaacggaaacggtaaacggtaccgtaacgtaacggttaacctaagggttaaccaaggtaacggtaacggccggtacgttcgttaagggtaacggtaaaggtaacggttccaacccgtagttccgaacgaaaggagtaataaggtaacttaaacgaaaggttaacctcgtaaccttgtaactccgtaagaactaaagtaccgaacgtataacccgaaggaaaccgtaggacgtacccggtagtcttaagttgtacggtaagaacgaactaaagggtgtgtaaggtggttggttaagggtctcggtataacgg

SEQ ID NO: 146798 - DNA, 804 bp, Homo sapiens
  misc_feature: GYAE6OF02I897X.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctccgaggggaangccacctctcctgcagctccagccagatactccagagctactacatacgcctggtaccagcagaacgcctggccaggcctaccgaggttccacatctatcggcgtcgggtcccacgacgggcctaacgtcggacctacgtcccgaagtacgtacggttccacgggtcggacgtacgggtcgggttacctacggggaacctacggttaaccctttcgaaccgtttccggttaccctaattaccgtaaacgttttacggaccgtaacggtaccgttacgggtaaccgtaccgtaacgggtaaacggttacgttttaccggacgtttaacggtttacggtttaacctttaaccgtcggttaaccgacggttacgttaagggttaacgtttacgggttaaccgtttacccgtaaccgtttccggttacggtttaccgggttaacccggggtaacccggttaaacggggtaacccgtaaaacggggtttaaacggtaaaaccggtttaaccggggtaaaaaccggttaaacccggtttgggttaaccgggtacccgtttaccggtaaccccgtttaacccggttaaccggttttaccgtttaaccccggg

SEQ ID NO: 146799 - DNA, 875 bp, Homo sapiens
  misc_feature: GYAE6OF02G8RHW.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtcttgtctccgagggaaangccaccctctcctgcacgtcctccgacgccaagtaaactactaccagacgtacctaactaacatacgccgttaggtaaccagacaagtaacgcctaggacccgaacggtcctacccgtacggttccctacgtacgttaccttacgtcggttaccggttccgggtacccccaacgggtacccgggtaccccgtaaccggttacgggacctaacccgttaccccggtaacggtaaccggtacgggttttacaacggggtcgggacgttacggggtttacgggtaccggtacggggtaacttaccgggttaaacccgtttcgtaacccgtttaccgtttacgtaacgtttaaccgtaacggttttaacggacccgttaaaacgggtaccgggttaccgggtacgttacccggttaaggttaacggtttaaccgttttaccggaacgtttacgggttaaacgttttaacgttacgttacgttaaccggtaacggtaaccggttaaggtttaacggttaacgggtttaacgttaacccgtttacgttaccggtttacggttaccgggtttaccggaaccggtaaccgggtaaacggtaacggttaaagtaaacggttaacgaaaccggtacgttaggtacggtaccggtacgaacccgtacttaccggtacgtttaacccgg

SEQ ID NO: 146800 - DNA, 707 bp, Homo sapiens
  misc_feature: GYAE6OF02IMEL6.21.4.A04.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcaagaaaccaccggagaaattgtgttgacgcagtcctccaggccaccctgtctttgtctccgaggggaaancgccaccctctcctgcagctccagccagaatactccaaganctactacatagctggtaccagacgagacgcctggaccaggcctcccgaggttccctcatctaatcgcgtcgggtaccagacggcctacgtggacctacgtcccgaagaccgtaggttcaggtacgcgtaggttcgggtcttacgggactaagtcttacaccttctactatacgtacttacggacaacgtaccgtagacgacgtagtaaacgtcgtttacgacgtaacgttagtttaacgttacgttacgacgtaacgtaccgttaagttaaccgttaggggtaaacctttaccgaaccgtttacgttaccgggtttacccgggttacccgggtaaacccgggttaacgggtaaaccccggttaaacgggtaaacgtaaacggtaacgggtaaaaacccggttacgttaacgggtaccggttacgttaaccggacccttaacggtacgttaccgttaacgg

SEQ ID NO: 146801 - DNA, 750 bp, Homo sapiens
  misc_feature: GYAE6OF02I6W2J.21.4.A04.1.454.CMB.1.raw
  modified_base (204)..(204): a, c, t, g, unknown or other
  misc_feature (204)..(204): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtagttgacgcagtctccgaggcaccctgtctttcgtctccgaggggaaancgcccaccctctcctgcagcctccagccaagtaatactccagacgctaactacagtacgcctacggtaccagcgaagaacgcctcggaccacggcctacccgtacggttcctaccgattcctagtcgtcgttaccgggtcccaacggacgggccctacgtggaccctaaccgtaccccgtaagaaccgtacggtttccgacgggttcggaccgtagggtcgggtacgtaggggaactacggtaccgttcaaccgtctacgtaacttcgaatttacggcgtaaacgtcgtaggacgtactaggtaaacgttcggttaccgaggtacggtttacgttaacttcgtacgtaccggtacgttaacgtcggttaaacggttacgggtaaccgttttaccctacgtttaacccggttcgggttacccggttaaccggaacccgggttaaaccgggtaccgttaaaacgggtttaacggaaaacttacgggaaaacccgttaggttacgggtacggtaccgtagacccgtaaccgtttacgttcgttaacccg

SEQ ID NO: 146802 - DNA, 695 bp, Homo sapiens
  misc_feature: GYAE6OF02JO95T.21.4.A04.1.454.CMB.1.raw
  modified_base (321)..(321): a, c, t, g, unknown or other
  misc_feature (321)..(321): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtcgtcgctcgcacgaccggtgctcgatttagagtagtgatcaggggagctctgagagcggagccccagccccagaattcccacggtgttttcatttggtgatcagcactgaacacagaggactcaccatggagtttgggctgagcgtgggttttccttgttgttattttacaaggtgtccagtgtgaggtgctagctggtgagtcgtgggggagacttggccagccgttggagggtcccctggacggacctctccctgtcggacctgcccttctgctaattccacccctttagagttacggaaccctactaaaaccngtacgggaccgttggggttccccgacctacgggtcctacccgggtaaggggaacgggtcctaggggtggtcgggtccggtaccgtagttacgaaaggaacgtacaaacgngtaacnggtaacaaggtaactcgggcgcgttcgagtacggaaaggtacggtcacgtatcgtacgaagtacgataggtactagaaacgtactacacgtacgttactcgataacgaattacgaactacggaaccttaacggaaacgaccggaactaacccgggtacgttaggttaactttggttaccgttaaggtaaacgtaaaccgggtaaaagttcggtacgtaacggttggtaacgggttaggttacgtacgtttcggtaagg

SEQ ID NO: 146803 - DNA, 862 bp, Homo sapiens
  misc_feature: GYAE6OF02JRTE3.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctgctcccaggctcagaaaccaccggagaattgtgttgacgcagtctccaggcaccctgtctttgtctccgaaggggaanacgccaccctcctcctgcacgcctccacgtaccaagtaactaactccaggacgacctaactacactacgtaccgtcggtaaccagtaccaaggaactcccgtaggaccctaggcctacccgtaggttaccctcgtactccgttatccggcgtccggtacccgacggacggtctaccgtcggtacctacctcccgaacggtaccgtacggttacgacggttcggtacgacgggtttcgggtacgtacggggaacgtaaccggtaaccttcccggtaaccgttaccgtacttaacctttacggtaacgtttaacggtacccgtaaccggtaaccggtacggggtaaaccgttacccggttaaagggttaaacccgtttaacgggttttcccgtaacggtttaacgggttttaacggtaacctttttaccgggtacgtaacccgtaaggtaaccgtaacggtttaagggttaaaccggggttaaccttaacccgggtttaccctttacggttaccgggtttaccggttaacccggggtaaacccgggttaacgggtaaacggttaaaccggggttaaaggttaaaacccggtaagttaaaaccgggtacgttaacggggttacggacgttaccggtacccgtaacttccggttaaccgtttccgg

SEQ ID NO: 146804 - DNA, 786 bp, Homo sapiens
  misc_feature: GYAE6OF02JBOZO.21.4.A04.1.454.CMB.1.raw
  modified_base (201)..(201): a, c, t, g, unknown or other
  misc_feature (201)..(201): n is a, c, g, or t
  modified_base (272)..(272): a, c, t, g, unknown or other
  misc_feature (272)..(272): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctacagaaaccaccggagtaaattgtgttgaccgcagtctccaggcaccctgtcttgtctcgaggggaancgccctaccctctcctgcacgctccagaccagaatactaccgagacgctactacagtacgccgtggtaccnggtacagacgccgtacggcccaggtccctcccgtacggtttcccctacgacttccgtagtacggtcccggttacccggggtacccacgggtaacccggggccctacggttcgggacctaacccgttaccccggaaggtaaaccgttacgggtttaccaggggtttaccggaccggttagggggtttaccggggttccgtaacggggtaacccgtaaggttacccctttaaccggtaccctttaccgtaacgttaaccgttaccgtaacgttaccggaaccgtaacgtacggtgggtaaccgtcgtaaacggttaacgtacgtttacgcggttaagtttacgttaactttcggacgttacgaggtaccgtagttacggttacgtaaacgttccgttactcggttccggtacgtccgggaaccggtacgggtaacgtaacgggtaaacgtaacgtaaacggaaacccggttagtcgggttacggaccgttagccaaccgttaccgttggttacccg

SEQ ID NO: 146805 - DNA, 871 bp, Homo sapiens
  misc_feature: GYAE6OF02JFAPQ.21.4.A04.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcacctgtcttgtctccgaggggaaanacgccaccctctccgtgcagcctccacgaccaagaactacgtccagacgtacctaactaccatacggcctacggtaaccaggacaaggaacgccgtacggccgacgccgtacccgtacggttcctacgtacttctacgtcggtcgtacgggtccccacggacgggtaccacggtacggacctaccgtacccgaaggaacgttacggttaccgacgggtacggtacggtagggtttcggggtacgtacgggggaacctaacgggtacccgttcctaccttacgtactaacttacgtaacgttaccggacgtaacggtaacgtagggtaacccgtacgttaaagggttacttaacgggtttaccggacgtttaacgggttaagttttaaaccgttacgtttaacggaccgtaacggtaacgggttaacgtttaaacggttaacggggtttaaaccgtttacccgtttaaccgttacgggttttaccgggtttacccgggtttaacccgggggtaacccggtaaaacgggggttaacccggtaaaaaggggggttttaaacccggtaaaaacgggttaaacccgggtaaaaccggtttaaccggtacgggtttaaccgggtaacctttaccggggtaaacccttaaccggtttacccgttacggttttaacccgg

SEQ ID NO: 146806 - DNA, 658 bp, Homo sapiens
  misc_feature: GYAE6OF02HC8N3.21.4.A04.1.454.CMB.1.raw
  modified_base (200)..(200): a, c, t, g, unknown or other
  misc_feature (200)..(200): n is a, c, g, or t
  modified_base (279)..(279): a, c, t, g, unknown or other
  misc_feature (279)..(279): n is a, c, g, or t
  modified_base (635)..(635): a, c, t, g, unknown or other
  misc_feature (635)..(635): n is a, c, g, or t
tcagtcgtcgctcgcacgaccggtgctcgatttagagtagtgatcaggggagagcgtgctcacgttaggacccagagggaaccatggaaacccagcgcagcttctcttcctcctgctactctggctccaggctcagaaaccgaccggagaattggtgttgacgcagtctccaggccacctgtctttgctcgaaggggaancgcccacctctctgcacgcctcacgctagaatacgtccagagcttacacagttacgccgtacggtaccagccaaggacnccgtaggccacggcccgtacccgacggtttccctacacgttactatcggccgtacgggtcccctaacggcggtaccacgtcggaccacgtcccgaagtacgtacggttcgaggttcgcggtaggtcggtcgagggtactacgtactcctacgtctacgtacgtcacgttacgcgtacgtacgtacggacgtacggtaacgtacgttacttcgacgttagtttaacggtttacgttacgttcgttaccgagttaccgtagtacgttaccggttaacgtcttccgttacgttcggttaccggttacgaagtaccggtaacgtaaggtaacggaacgttagtaacgtacgtgttacggnttaccgaacgtctagttcttacg

SEQ ID NO: 146807 - DNA, 803 bp, Homo sapiens
  misc_feature: GYAE6OF02JOAOX.21.4.A04.1.454.CMB.1.raw
  modified_base (383)..(383): a, c, t, g, unknown or other
  misc_feature (383)..(383): n is a, c, g, or t
  modified_base (414)..(414): a, c, t, g, unknown or other
  misc_feature (414)..(414): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtagtgatcaggggagagctgctcagttaggacccagagggaaccatggaaaccccagcgcagcttctcgttcctcctgctactctggcctcccaggctcagaaaccaccggagaaattgtgttgacgcagtctccgaggcctacccgtgtcctttcgtcctaccgaagggggaaactcgaccctaccccgttcgttcccgtggaccaggtccgtacccaggacccaaggaacttacgtacccgaggaacgtaccttaacgtacagttacgccctagggtaaccacggactaaggaaccgccgtggacccagggtccctacccgacggtttccactaagtccttagngtcccgttaccgggccctacggacggtcccncgttcggcctacgtacccgaggtaaccgtacggttcgaaggttccggntaacgggtggacgtagggactagtacctctagtcctacgatacgagttacgcgtaacgtacgtggtaacgtcgttacgtaagtccgtttccgacgtaacggtttacgttaacgtttcgttaggtaacctacgtaacgtttacggtaacgttaccggggtaacctttaccgtaacccgtttaccggggttacgttacccggttacccgggaacgttaacccggggttaacgtaaaccgggttaaccgggtaaacgtaaccggttaaaaccggtaaccggtttacgtacccggttaacggacccgtttaaacccgggactttacccggttaacgtttcccggg

SEQ ID NO: 146808 - DNA, 716 bp, Homo sapiens
  misc_feature: GYAE6OF02GBK9M.21.4.A04.1.454.CMB.1.raw
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcagctgggtgagtcgtgggggagtacgttggtccacgtccgtgggacgggtccctggaagtaccttctccgtgtcgcacgtcctctcgctattaccaaccttcgagtcgaacctacaactagtacggacgtcgggtcccgccgacggcctaccggaaggggtacggggcgtagggaggttcgggtaccggtaccgttaacgttaacggaaaggtaaacgtacctttaaacggtaagtttacgtaagtaaaccgaagtaaaccgtacgggaccgtaccggttacgtaggtaacgggaaaggtaaccggtcaacccgtagtacgtacgaaaacggtacgtaagttactaaacgttaccgaaaaagttaccctagtaaccgttagtactacctagaacaaagtacgaaacgaccgtaacgtaaaccggaaacggtacggaccgtacggtacgttagtagtttaggtacggtaaggtaaactaagaaaggtgtacggtaaggttcggtggtaggtggtacgtgtacg

SEQ ID NO: 146809 - DNA, 642 bp, Homo sapiens
  misc_feature: GYAE6OF02HU0ID.21.4.A04.1.454.CMB.1.raw
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgcctcgaggggaaagcgccaccctctcctgcagctccagccaagaatactccgaagacgcctactacatagccgtggtaccagccagaacgccgtaggccaggcctacccgtaggttccctcactctagtcggccgttcgggtaccccacgacgggcccacgtcgggacctacgtaccccgaaggaaccgtacggttaccgagggtcgggacgtagggttcgggtacgtcggggactagtacccttcgacctctacatctatacgcgagactggactacgtagtaagtcttcggactgttacgttnttacgtntacgtagcgtaagtgtagtacgttcctacgttcgtcgttccggtaccgaccggtaagggtaccgaagggtaacgtaaaacggtacggtaaaaccggttacgttaggtacggtaccgtacgaccgtaccctagttccgttacgg

SEQ ID NO: 146810 - DNA, 849 bp, Homo sapiens
  misc_feature: GYAE6OF02JGSXK.21.4.A04.1.454.CMB.1.raw
  modified_base (190)..(190): a, c, t, g, unknown or other
  misc_feature (190)..(190): n is a, c, g, or t
  modified_base (794)..(794): a, c, t, g, unknown or other
  misc_feature (794)..(794): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggtttccttgttgttatttacaggtgtccagtgtgaggtncgagctggtggagtcgtgggggagtacttggtccagccgtggacggtcctgacgtactctccgtgtcgcacgccttctcgctacgttcctaccttacgagtcgaaccctaacaaacgtcgtacgggaccgttcggggtccgaccgacgggtcctaccgggaaggggtaacggggtcgtcggggaaggttcgggggtccggtaccggttaacgttaacggaaaacggtaaacggtactttaaaaccggtacggtttaaccaacggtaaaccgaacggtaaacgtacccggggaccgtccgttaccggttaggaacggtaaaagggtaccggtttacccaaaccgttagttccgtaaacgaaaggtacggtaacttaacggtaaaccttaacggaaaacgtaaccttacgtaacttaagtaaccgttacgtaacgtaaaccgtaaagtaccggaaaacccgcggttaaacccgtaaacgggaaaacccggtaacgggtaaaccccggtacccgggtaagtttaacggttaacgttttaacggtaccgggggtttaaaacggtaaaccggttaaaaaccgaaaggggttacgggttttaaacccggnggttttaacggggtttgggtaacccggggtttaattaccggttacgggttaacgg

SEQ ID NO: 146811 - DNA, 744 bp, Homo sapiens
  misc_feature: GYAE6OF02JARVZ.21.4.A04.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgtgacgcagtctcaggcaccctgtctttgtctccgagggaanacgccaccctctccncgcagctccgacgccagaactatccaagacgtacctaactacatacgcctaggtaccagacaaggaactccgtacggaccgacggtcctacccgtacggttccctacacgttctacgtcggtcgtaccgggtaccccaacggtcggggaccctaaccggttggaccctaccttaccccgagtaaccggtacggttaccgtaagggtcggtaccggtacgggtttacggggtccgttaggggaaccgtaccgttaaccgttacctacggtttaccacgtacctttcgaacgtttacggactacgtcggtaggtacgtccgtaagtacgtacgttcgcttaggtacgttataccggtcgtacgacgtagttacggtaacgtagggtttaccttacctaccggtttacgtacggttacccggttacggaaccggtaaccggggtaaacgaacggttaacggtaacggttaaacgaaaacggtcgtttaaggaccgggttactaccggtaacgaaccggttacctacggtttaccg

SEQ ID NO: 146812 - DNA, 527 bp, Homo sapiens
  misc_feature: GYAE6OF02GKT8L.21.4.A04.1.454.CMB.1.raw
  modified_base (408)..(408): a, c, t, g, unknown or other
  misc_feature (408)..(408): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtctgggggagacttggtccagcctggagggtccctgagactctcctgtgcagcctctgcattcaccttcagtgaccacaacatggactggggtccgccaggctccgagggaaggggctgggagtgggtcgccgtatacaaggaaagctaacagttacagtacagaatacggcgcgtctgagaaaggagttcacatctcaaganatgattacaaagaactcgactgtatctgacaaatgaacagacctagaaaaccgnggacacggccgtagtattatggtaggtagaacaaagtgtaggagtggtaggtggtagtctgtacg

SEQ ID NO: 146813 - DNA, 737 bp, Homo sapiens
  misc_feature: GYAE6OF02F08Z7.21.4.A04.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgggcacctgtctttgtctccgaggggaaangccacctctcctgcagctccagccagaatntccagacgctacgtacatacgctacggtaccagctaagaacgacctggaccacggcctacccgaggtttccctactacgtcttacgtcgcgtccgggtaccccacggacggggccctaacgtcgggacctacgtaccccgaagaccgtaaggtttccgaaggttcgggtacgagggttcggggtacgttacgggggaactacgggttaaccgtttaccggaacccttccgttacctacggtactaacgttacggacgtaacggtacgttacgggaacgtccgtaagtaacggtaccgttacggaccgttagggttacttaacgtttaacgttcgttacgtacgtacgtaacggttagttacgggtaacgttaccgtaccgttacgttcgttccggttacgggacccgtaacgggtaacccgtaagggtaacgtaaaacggttaccgaaaacggttaccgtaggttacggtacgtacgtaaccgtacgtaacttcgttacgttacccg

SEQ ID NO: 146814 - DNA, 662 bp, Homo sapiens
  misc_feature: GYAE6OF02FH95V.21.4.A04.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccaggggaaangccaccctctcctgcagcctccagccagaatactccagacgctactacatagcctggtacccagccagaagcctggccaggcctcccaggttccctcntcctatcgcttcgggtccccagacgggccctacgtgggcctactcccgagactacggtttcaggtggctagggtcgggtacgtggggacaggtacctttcgaccttccgtacagtacctagttacgacaacgtacgtcgggacgtcccgtaggaaacgttcgtttaccgaccgtaggtttacgttaactttacgtcgttacgtaacggtactaaggttacgttacgggttaactttccgtaaccttcgttcgttccggtttacccggaaccgtacgggaccgtaaagggttaacgtaaacgtaacggtaaaccgttaacggttggttacggaccgttagaacctacccgttattaccgtttaccg

SEQ ID NO: 146815 - DNA, 760 bp, Homo sapiens
  misc_feature: GYAE6OF02HX3EO.21.4.A04.1.454.CMB.1.raw
  modified_base (190)..(190): a, c, t, g, unknown or other
  misc_feature (190)..(190): n is a, c, g, or t
  modified_base (289)..(289): a, c, t, g, unknown or other
  misc_feature (289)..(289): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttggctgagctgggttttccttgttgttatttacaggtgtccagtgtgaggngcagcgtggtggagtcggtgggggacgtacgttggtaccgacgtccgtgggaccggtcccgtaggacggtacttccgtccgtgtcgcgcgtccttccgngtctactttccaccttcacggtaccgaacccaacgtaacgacgtcggtacgtccggggtacccgccgacgggtccgtaccggaacggggtacgggtcgtgggtaggtcggggtccggtaccgttaacgtaacggaaaacggtaagtacctaaacggacgtttaacgaacgtaacggaagaaaccgtacgggacccggtcgttacggtagggtaaacgggtaaacgggttaccgttacccgtaacccgtaagttacccgtaacggaaagtaagtaacgtacggttaacgttaaacccgtaaaaggtaacccctggttacctacgtaatccgtaagtacaaacgtacgtacgaaccgtaccgtaacgggaaaccgtaggaccaccgggtacgtttacgtagtttccgtaaggtcggttaacggaacttaaaggtacgtaggcggttaggtacgggtcggtactcgttagaccg

SEQ ID NO: 146816 - DNA, 781 bp, Homo sapiens
  misc_feature: GYAE6OF02GHNX0.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaanacgccaccctctcctgcagcctccagccagaactactccgagacgtacctaactacagtcggtccttagggtacccaagccgaaggaaacgcccgttcgggacccgtagggccctccccggtaggttccctcgtaacttctatcgccgtcgggtaccccacgacgggcccacgtcggcacgtcccgagaccgtaggttcaggtcgacgtgggtgggtcgtacggggactacggtaccttaccgaacttccgtactaattcgtaactttacgacgtacggtacgtacggacgtaccgtaaggtacgttacgtttcgaacgttcgggttatttaaccgtttacgtcggttaacgtacgttacgttagggttaagtttaccggggttaacctttacccgggttacccgtttacgggttaccggtttaacccgggttacccggggaaccgggttaaacccggggtaaacccggttaaaaggggttaaaccggttaaaacggtaaaccgggttaaaacccgtaacgggtttcggttaccggtaccgttaccggtaccctaaccgttaccgttccgttttaaccgg

SEQ ID NO: 146817 - DNA, 907 bp, Homo sapiens
  misc_feature: GYAE6OF02H99BS.21.4.A04.1.454.CMB.1.raw
tcagtcgtcgctcgcacgaccggtgctcgatttagagtagtgatcagggagagctgctcagttaggaccagagggaaccataggaaaccccagcgcacgcttctcttcctcctgctactctcggctcccgaggctacaaacgaacccgaaccggaagtaaaattcggttgtttacggaccgactaacggttcctaccgaagggccctaaccccgttggtttccgttttcggtaccgttaccggaaaggggggtaaaacgaccggtaccccaacccgtttccttacccgtacggaccgaccgtaccttaccgaacgtacccgtaaaggtaaacttaacgaccgaacggtaacgtaccgtttaaacctaacgaacgttaaaccggtccgttaaccgggtaaccaaacggtaaccgaaaacgggttaaacgtccccgtaagggtaaccccggtaaggtacccgtttaaccggtacccggtttacccgtaaccgtaaccgtttagttaccggtttacgggttacccgggtaacccaacgggtaaccgggtaccctaacggtacggaccgttaaaccgccccgtaaaggtaaccgtaacggttacggacggtaaggtaaccgtgggtacggtacggtacggtaacgtactaccgttactaccgtactacgtaacgtacgtaacgtacgtacgtaacgtacggtacggtacgtaccgtaacggtaacgttacgttacgtacgtacggttacgttaacgttacgtacgtacgtacgtacgttagtacgtacgtaacgttacgtacgttacgttacgtaccggtacggtaaccgtacgggggactaaggtaacgtaacggtaacgacgttaacgtacgtacgacgtacgtacgtaacgtacgtacgtagttaccg

SEQ ID NO: 146818 - DNA, 728 bp, Homo sapiens
  misc_feature: GYAE6OF02GLEFZ.21.4.A04.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccagctcagaaacccaccggagaaattgtgttgacgcagtcctccaggcctaccctgttctttgtcctccgaggggaaacncgcccaccctctcctgcanccttccagacccagaactactccagagccttacacatagcctggtaccagcagaacnccgtggccaggcctcccgtacgttcctcacttctactgccgtcggtacccacgacggccacgtcgccaccgtcccgaagtaccgacggttcgacggttcgggacgtacgggtgggttacggtacgggggtacctacgggttacccttaccgtacccgttccttacgtacttaccgtaaacgtttacggaccgtaagtaaccggttagggaaccgtccgttaacgggtaagttacgtttaccgaacggtacgtttacggttaacctttaagtccggtaccgacggtactaggttaacgtacggttaacgtttacctacgttccgttacggttaccggttacgacccgaacgggtaaccgtaagggtaaaccaaggtaaaccggaaaccggttaacgtcggttaccgggacgtacccgaccgttaacccgtagttacccggttaccg

SEQ ID NO: 146819 - DNA, 779 bp, Homo sapiens
  misc_feature: GYAE6OF02H93YD.21.4.A04.1.454.CMB.1.raw
  modified_base (194)..(194): a, c, t, g, unknown or other
  misc_feature (194)..(194): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggagtttgggctgagcttgggttttccttgttgttattttacagtgtcagtgtgaggtgcngcgtggtggagtcggtgggggatacgttggtccagtccgtgggacgggtccctgacgacttctcgtgtcgccagtccctcgtgctacttccgaccttcgagtaccgaacccaactaaacgtagtcgggtaccgttcggggtccccgccgaggtccgtaccgggaagggggaacgggtccgtggggaacgggttccggggtaccggtacggttaagttaacggaaagggtaaacgtacgtaaacgtagtttaaccgaagttaacgaaacggttacgtaaccgggcgttcggtaccgtagggttaacgggaaaacgggtaggttaccaacccgtattaccgtaacgaaacgtagacgttaagaactttaacgaaaccgttaacctacgtaacttacggttaactcgtaacgaacgtaaacgtaaccgaacgtaaccgaccggttaaacgaaaaacccgggttacggaaacggtacccggttaacgttagttaacgttttagtacgggtaagtaaacggaacgtaaaagggttcgtaagggttaccggttaggttacgggttaggacgtttaccggtagttaacccgg

SEQ ID NO: 146820 - DNA, 545 bp, Homo sapiens
  misc_feature: GYAE6OF02F3D6A.21.4.A04.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtggggganacttgggtccagcctggacgggtccctgagactctcctgtgcagcctctgcattccaccttcngtgaccataacatggactgggtccnccgaggtcctaccgaggggaacgggctggagtgggtcggcgtattacaaggaaagctaacagttacagtacgagaaagtcggcgcgtcgtgtaggaaaggtaggttacaccgatcgtacaagagatagattacgaaanactanactagtactctgacaaatagaacnacctagaaaccngacacggctgtattagtgtaggaanaacgaaagtcgtagatgggtaggtgtagtctgtacg

SEQ ID NO: 146821 - DNA, 897 bp, Homo sapiens
  misc_feature: GYAE6OF02JKF2K.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagctgggttttcctgttgttatttacaaggtgtccagtgtgaggtgacaggntcggtggacgttcgtagggggatacgtttggaccaggccgtagggacgggttccctggacgtacctcgttcctggtcgctacggtcctctacggctaacttcccaccgttacggtacgttacggaaccctacaacccgtaggtaccgggacggttaccggggttccccggaaccacgggtccttacccggggaaggggtaaccgggtccgtagggtaacgggttcggggtaccgtacgttaacgtaccgggaaacgtaacggtcccgtaaacggtagttaacccgtaggtaaacccgaggtaaaccgtccgggactcggttacagggtaaggtaaacgggtacgggttcccaacgtcgttaccgtaacgaaggtagtacgttacgtaaccttaacggtaaacgtaccccgttagacggtttacggttaaccttaacgggacctaaacgttaaaacggtaccggtaaaccggaaccgttttaaaccggaaccggggttaaaaacccggacggggtaaaccccgttaccggggggttaacttttcccgggttttaaaagttttaccggggtttaacccggttaaacggggtaaaagtaaacccggttaaaaacgggggttccggttaaggggttacccggtttacggggtttaacccggggttaaccgggtttacgggtacccgtttacggggtaaacccggg

SEQ ID NO: 146822 - DNA, 707 bp, Homo sapiens
  misc_feature: GYAE6OF02HGB0Q.21.4.A04.1.454.CMB.1.raw
tcagtcgtcgctcgcacgaccggtgctcgatttagagtagtgatcaggggagagctgctcagttaggaccagagggaaccatggaaacccagcgcagcttctcttcctcctgctactctggcctcccaggctacaacgaaaccaccggagaaattgtgttgacgcagtctccgaggccaccctgttctttcgtctacggaaggggaacacgccaccctctcctgcacgcctccgacgaccaagaatactaccaggactactactacatacgtaccttcggtaacacgacgaagaagcccgacggaccgacggtacctaccccggttacggtttcccacgaacttcttaacggtccgtccggtaccgggtaccccaacgggtaacggccctacgtacggtaccaccttacccgagaaccggtacggttacacgggttcgacgaggggtttacgggcgtaacggggaactacggtaccttcgaacttacgtatactacgtacgtacgtactaacgacggtacggacgtacgtaggtaacgtacgttacgacgtagttactattacgtgacgacgacgtagttaacgtagtaacgtctacgttgtacggtacggttacgaccggtacggtaaccgtaaggtaacggtaaacgtaacggaaacgttacggtaggttacggacggtacctaaccgtacgtaccgtagttacg

SEQ ID NO: 146823 - DNA, 753 bp, Homo sapiens
  misc_feature: GYAE6OF02FTS5C.21.4.A04.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtgtgacgcagtctccaggcaccctgtctttgtctaccgaggggaaangcccaccgtctcctgccagctccgagccagaatcnccagagccttactaacagtacgccgtaggtaccagacaggaacgccgtggcccaggcctacccgaggtttcccncattctagtgccgttcgggtacccacggcgggtccaacgttcggcctacgtccccgaaggtacctaagggtttccagggttggccgaaagggtttcgggtacggtcgggaaaccgtaaggttaccctttaccgaccgttaccttcctaagtaccgtaaagtttaacggacgaaccggtaacggtacgggaacggtacccgttaggtaaacggttaacgttttaccggtaccgtagggttaacgttaacgtttaccgtaggttaccgacgtacgttaacttaggttacggtaacgttacctaccggttacgttacggttaccgtttaccgggaccggtaaccgggtaaccggtaaacgggttaaacggtaacgttaaaccgggtaaacgtaaccgttacggtacgggtaactaccgggtacctacccgtagttaccgttaccgg

SEQ ID NO: 146824 - DNA, 719 bp, Homo sapiens
  misc_feature: GYAE6OF02HVG6N.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcgtggttttccttgttgttattttacaaggtgtcagtgtgaggtgcagcgtggtggagtcgtgggggatacgttggtcagccgtgggacgggtccctaggacgtacttccgtcctgtgcacgccctctcgcctatttccctaccttcacggtaccgacccgaaccaaacacgtggtaaccgtcgggttccccgccgtaacggtcccgtaccggaagggggtaacgggggtaccgtaggggacgggttacggggtccgggtaccgttaacgtttaaaccggaaaaaggaaacgtacctaaacgtaacgtaacgtaacgtaacgaaagtaacgtaaccgggtcgtccgtcgtagggtaagaaagggtacgtaccaacgtaactcctaacgaagaagtactagtaatacgaaaacgtactacgacttagttaactcgtaagacgtaaaactagaaactacgtaccaaaccggaaaacggacggaaaccgaccggttacgttagttaatttgtaggtaacggacgtaaaagaaggttaggagtaggttaggtaggttaggtagtacgtaggtacgg

SEQ ID NO: 146825 - DNA, 822 bp, Homo sapiens
  misc_feature: GYAE6OF02IOOPU.21.4.A04.1.454.CMB.1.raw
  modified_base (150)..(150): a, c, t, g, unknown or other
  misc_feature (150)..(150): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcaagaaccaccgganaaattgtgttgacgcagtcctaccaggccaccctgttctttgtctcgaggggaacncgcccaccctctcctncagctccacgccaagaactactaccgagacgtacctactacgatacgtacccgttacggtaacccagtaccgaaggtaaccgccgttccgggaacccacgggtccctacccccggtacggtttccctacgtaacttccgttaagtcggtccggttacccggggtacccccaacgggtaccggggtaccctaaccggttcggaccaaccgttccccggaaacggttaccgtacggtttaccgacgggttggaccggtaaggggtttcggggtcggtacggggaactaacggttaccttccgaaccttcctagtaccttagtacgtttaacgacgtacggtaccgtagggaccgtaccgttaggaaccgttacgttacggacgttaagttcgtttaacttccgtacggtactaaggtacgttaaaggttacgtaagggttaccttaccgttacctttccgggttacgttcccggggtttaccgaacccgggttaacgggtaaaccggtaaggtaaagggttaaaccgtaaacggtaaaccgttaacggttaggttacccgggtaccgtaccggtacccctaaccgtttacgtccgtttaacg

SEQ ID NO: 146826 - DNA, 746 bp, Homo sapiens
  misc_feature: GYAE6OF02HRG00.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttagacgcagtctccaggcaccctgtctttgtctccgaaggggaaancgcccaccctctcctgacagcctccagccagaactagtccagacgctaactacagtacgccgtacggtaccagacagaacgccgtacggacccgacggtcctacccgtacggtttccactacgttctagtcgcggttccggccccgacgcgggtaccgacgtcggacctacctacccgacgtaccgtaggtccgtaaggtcggacgtacgggtcggtacggtcgggactacgttacgttaccgtctaccgttacacttacgtacgttagaccgagtaccgttagggacctaccggttaggtaaacgttacgtttaccggtacgtaacggtttacgttacgttttacgtacggttacgtacgtacgttaaacgttcggtaagggtttacgttacccgttacgttttccgttacggtttacccgggtaccggtaaccgggtaaaccggggtacgttaaacgggtaaagtaaaacggttacggaaaaccgttacggttaacggtacgggtaccttaccggaccgttaacttcgttaacgtttccgg

SEQ ID NO: 146827 - DNA, 685 bp, Homo sapiens
  misc_feature: GYAE6OF02FGOFP.21.4.A04.1.454.CMB.1.raw
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (572)..(572): a, c, t, g, unknown or other
  misc_feature (572)..(572): n is a, c, g, or t
  modified_base (582)..(582): a, c, t, g, unknown or other
  misc_feature (582)..(582): n is a, c, g, or t
tcagtcgtcgctcgcacgaccggtgctcgatttagagtagtgatcaggggagctctgagagcggagccccgagccccagaattcccaggtgttttcatttggtgatcagcactgacacagaggactcaccatggagtttggctgagtctggttttccttgttagttatttacaaggtgtccagtgtcgaggtgcagctggtggagtcgtggggactacgttggtccagccgtggacggtccctgagtacctctccgtgtcgcacgtcctctgactattcctaccttcagtcgacccanacngtagacgtcggcccncgacgcctaccggagggacgggcngggaggtcggggtaccggacgttaactaacggaacggaactccgtaacgtacgttaacgaacgtaacaggaacgtccgggccgtacgtccgtagggtaggaaacggttacggtaccaccgtatccgtaacgaagtacagttcgtaaacgtacgtaaacgtacctacgttaccgtgtacgtaccgtaggaaacaagttaccgaaccgtacgtacccgaaacggtaaacccggngtaacccggnggtaacccgtttagtttacgttacgttggtaaacgtaacggtaaacgtaaggttaggtaccggttagttacgggtacggagttacgttaccgtaggtaacccg

SEQ ID NO: 146828 - DNA, 668 bp, Homo sapiens
  misc_feature: GYAE6OF02JZXLS.21.4.A04.1.454.CMB.1.raw
  modified_base (267)..(267): a, c, t, g, unknown or other
  misc_feature (267)..(267): n is a, c, g, or t
  modified_base (325)..(325): a, c, t, g, unknown or other
  misc_feature (325)..(325): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagtaaattggtgtagacgcagtcctccaggccaccctgttctttgctccgaagggggaaacagaccctaccctctcctgccagctccagacccagaactactaccgagagtactacctanatacgcctacggtaacagcagtaaccgtccacggcctaaggtcctccgtacgttaccncgatctatcgtacgtccggtacccagtacggggcctacgtagtaccacgtacccaaggtaccggtacgttacgacggttcggacggtacggtcgggtcgagggtacaacgtcgttacctacgttccactatactatccgacgtagtacgtggaacgtcgttaacgaacgtaccgttacgtcgtagttacttacgttaccgtgtaacgtacgtcgtaaggtacgaggttacttccgtaccgttcgtacgttccgggtccgtaaccggtaccggtaacgtagggtaaccgtaaagtcggtaaacgtacggtggtacggtcgtcgtactaacggtactccggttaa

SEQ ID NO: 146829 - DNA, 890 bp, Homo sapiens
  misc_feature: GYAE6OF02HW7QA.21.4.A04.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtggttgacgcagtctccgaggcctaccctgttctttgtcctccgaaggggaanactccaccctctcctgctacgtccgtccacgaccgaagtaaacttacgtacccgaagtacggtacctaacctaacgacgttaccggcccgttaacgggtaacccagaccgtaaggaaccgtccgttacgggaccccgaagggtcccttaccccgtagggtttacccctacgtacgttccgttaacgtcggtacccggttccggggtaccccaaccggacggggtccctaacggtcgggacctaaccgttacccccgaaggtaaccggttacgggtttaccgaggttaccggggacgtacggggtttcggggtaccgtagggggtaacctaacgggttacccttacggtaacccttccgtacgttaaccgtacgtttaaccgttaggaccgtaaggtaccggtcgggtaacgtaccgtaaggtaaacgttacgttcgtaacggttacgttacgttttaacgtttacgtcggttaacgacggttacggttaacgtacggtttacgggtaaaccgttttcccacccggttttacgttaccgggttaacccgggtttcccggaaaccgggtaaccggggtaaacggttaaaacgggtaacggtaaaaccgttaacgggtaaaaccgttaacggtacggttacggtaccggtacgttaaccccggaacttaccgtttacggtttaccgg

SEQ ID NO: 146830 - DNA, 722 bp, Homo sapiens
  misc_feature: GYAE6OF02HYPW6.21.4.A04.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctaccgaggggaaangccaccctctccngcagtctccagccagaactacgtccagagcctactacatacgccttggaccagcagacgccgtggccacggctacccgtaggttccctacacgttccttagtcgtccggtcgggtaccccaggaccgggtccctacgtcggacctacctacccgagtaccggtacggtttcgaacggttcgggacctaaggggtttccgggttacgtaacgggggaaccttacggttacccgtttccaaccgtttcgtaacctcgttaccaagtttacggaccgtacggtacgttagggtaccgtaccgtggtaacggttcgttttacgacgtttacgtaaggtttacctaacgtttggacctaggttacgaaggttacgttacgggtaacgtttcccgtccggtttacgttgggttacccgttacgggacccgttaaaggggccttaaagggaacgttaacgtaggtaaaccgtagtacggtcggactacgtaacccgttctaccgttgttacccg

SEQ ID NO: 146831 - DNA, 838 bp, Homo sapiens
  misc_feature: GYAE6OF02JLXSE.21.4.A04.1.454.CMB.1.raw
  modified_base (192)..(192): a, c, t, g, unknown or other
  misc_feature (192)..(192): n is a, c, g, or t
tcagtcgtcgctcgcacgaccggtgctcgatttagagtagtgatcagggggagctctgagagcggagccccagccccagaattcccaggtgtttcatttggtgatcagcactgaacacagaggactcaccatggagtttgggctgagcttggtttccttgttgttatttacaaggtgtccagtgtagaggtncagctggtggagtcgtagggggatacgttggtaccagtccggtgggtaacgggtccccttaggaacgtaccttccgtccgtaggtcgacgacggtccctcgtacgctaacgtttccaccgttacacggttaccgaaccctaactaaaccgtacgttcgggtacgtcgggttaccccgccgtaacgggtcctaccggaagggggacggggtcgtaggggtaggtcggggtacccgtacgttaagtaaccggaaaggaacgtaccgttaaacgtaagttaacgtacggtaaccgaaggtaaaccgtaccgggacgtacccggtacgtaaggtaaagggaacgtaacggttaccgaccgtagttaaccgtaacgtaaacggtacgtaacggtactaacgttaaccaaaacggtacgttacccgagtttacgtaactccggtaactaacggaaaagttacccaaacgggtacctaaacccggtaacggtaaaaaccgccgggtaaaccggtaaccccggttagttaacgtttagtttaaacccgttgggggttaaaacccggtaagaaaaaccggggtttagtaaaccggggtttagtaagggtttacggtaggggtttaaacggtcccggtttagggaagttaacccgg

SEQ ID NO: 146832 - DNA, 767 bp, Homo sapiens
  misc_feature: GYAE6OF02GC67Z.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagcgtgggtggagtcggtgggggagtacgttgggtccaggccgtgggacgggttcccctggacgacctctcctgtgcacgcctctgctatcaccttcagtcaccacaacagtacggacgtcgggtcccgaccgaggtcccgtaccggaagggggaacgggcgtaggggtacggtcggggtcggtaccgttaaagttaacgaaagggtaaacgtaaccgttaaacgaacgtttaaccaagtaacgaaggtaaacgtaccgggccgtacgttcgtaggtaagggtaaaagggtacgggttaccaaaccgttacgttacccgtaacgaaaggtaagtaaggttaactaaagttaaccgaaaacgttaacccgtactaaccgtttagtaaccttcgtacgtaactaaacgtaagtaaaccgacggtaaccgttaaaccgggaaaaacccgtaccgggtaaaccggtaaccgggtacccgttagtttaacgtttagttacgggttaaggtaaacggtaaacgtaaaggtaacggtaggtacgttagggttcgggtaggtacggtagtacggtaaccgg

SEQ ID NO: 146833 - DNA, 857 bp, Homo sapiens
  misc_feature: GYAE6OF02GZO1L.21.4.A04.1.454.CMB.1.raw
  modified_base (209)..(209): a, c, t, g, unknown or other
  misc_feature (209)..(209): n is a, c, g, or t
  modified_base (829)..(829): a, c, t, g, unknown or other
  misc_feature (829)..(829): n is a, c, g, or t
tcagtcgtcgctcgcacgaccggtgctcgatttagagtagtgatcagggggagagctgctcagttaaggacccagagggaaccatggaaaccccagcgcagcttctcttcctcctgctactctggctcccaggctcaacgaaaccaaccgggagaaatttgtgttgacgcaggtctccaggccacctgtctttgtcctacgaggggaanatcccaccctcgtcctgcagcctccagccaagaactactccagacgctaactacacgtacgaccgtaggtaccagacaacggaacgaccgtacggacccgacggccctacccgtacggttccctacgtattaccgttagtcgtccgttaccggggtaccccgtaacggaccgggacctacgttacggcctaccgtaccccgtaaggaccgttaacggttcggtaacggttcggacgggtacggtttacggggttacggtacgggggtaaccgtaacggttaacccgttccgtaaccgttacccgttaaccgtaacttaccggttaaacgttaacgggtaccgaaccggttaacgggttaacggacgggttaccgtaagggtaaacgtttaccggtttaccggttacgttaacggtttacggtttaaacctttacggttacgtaacggtaacggttacggttaagtttaacgggttaacggttaaccgtttaacccgttaccgtttacggttaccgggttacccgggtttaaccgggaccggtaacggggtaaccgttaaagggtaaacgtaaaacggttacggtaaaaccgttacggttcgggtaccgtacggttaaccncccggttaacgtaccgtttgttaacccg

SEQ ID NO: 146834 - DNA, 743 bp, Homo sapiens
  misc_feature: GYAE6OF02JPDKY.21.4.A04.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
  modified_base (715)..(715): a, c, t, g, unknown or other
  misc_feature (715)..(715): n is a, c, g, or t
  modified_base (737)..(737): a, c, t, g, unknown or other
  misc_feature (737)..(737): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaacccaccggagtaaattgtgttaggacgcagtctaccgaggccaccctgtctttcgctaccgaggggaaancgtcccacccgttntcccgtgccgacgcctaccgacgacctaagtaattaccaccgagtacgtacctaacgtaacgtaataccgtccgttacgtaacccgagaccgaacgaacgtccgtaggacctacggccttaccccgtagtttccccagtacttacgtacgtcggtaccgttaccgggtacccaacggaccgggtaccctaccggcggtacctaaccggtcccgagtaaaccgtggtttaccaggttaccgngtacgggttacggtacggaccggtanaaacgttcccgtaccttacccgtatcgtaaccttaccgttacgttacggaccgtaacgttacggtacggtacgttacgtacgtaacgttcgttaccgtagttacgttagtacttaacgtcgtccgaagtcgtagttaagtgtacctacgtccgttacgtcgttaccgggtacgacggtacgtacgttaaggtaacctaatacgtaacggtaccgtgttaccgngtaactaccggtataccgtttntaaccg

SEQ ID NO: 146835 - DNA, 797 bp, Homo sapiens
  misc_feature: GYAE6OF02F1KB9.21.4.A04.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccgganaaattgtgttgacgcacgtctccaggccaccctgtctttgctcgagggaancgccacctctcctgcacgtcctccacgccaagtaacttacnccgaagacgtaccttaacgtaccaagtaccggtaccgttacggtaccgagaccgaaacggaacggtcccgttacgggacctacgggtcccttacccgtacgggttccctcacgttcgtaacgtcggtcgtaccggtacccacgtacgggccctacgtcgaccacgttcccgaaggacgtaacggttcgagggtaccgtcggtaagggttcgggtaccgtagggtaaaccgagttacccttcgaaccctttcaactacgttaccgtaagttacgcgaacggtacgtacgggtacgaccgtaagtaacgtcgttacggtacgtagttacggttaaccttagttaccggtcctaacggtacgttacggttaacggttacggtaaccgtttaccgtaaccgttacgtttaccgggttaccgggtaccggtaacccggtacgggtaaccgttaacgggtaaaccggttaaacgtaaaccggtaaaccggtttacccgggtaaggttacccggtaacgggttacccgttaacccggtacccggtttacgtaccggttttaaccg

SEQ ID NO: 146836 - DNA, 668 bp, Homo sapiens
  misc_feature: GYAE6OF02FM5MC.21.4.A04.1.454.CMB.1.raw
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaagacgcccaccctctcctgcacgcctccagccaagaatactccagagctaactacatagcctgtaccagacagaagcctggccaggcctcccgacgttccctnactntatgcgttacggtccccacgacgggacccacgtcggcacgtacccagtaaccgtaggttcagggtgggacgtacgggttcggggtcgtacggggaactaacgtacctttaccgtaccttactcctaattacgtaagtttacgacgacggacgtcggaacggtcccgtaggtaacggtagtttcgacgtagttacggttacttacgttgtacaggtacgtaagttacggtaacggttaacgttaccgtaccgtacgttcggttacggttaccggacggtaacggaccggtaacggttaacgaaacgtaacggaaacgtaacgtacggtacggtcgtagacctaacgtacgttacgttaccg

SEQ ID NO: 146837 - DNA, 552 bp, Homo sapiens
  misc_feature: GYAE6OF02IG7LC.21.4.A04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (210)..(211): a, c, t, g, unknown or other
  misc_feature (210)..(211): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (289)..(289): a, c, t, g, unknown or other
  misc_feature (289)..(289): n is a, c, g, or t
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcagggaaangccaccctntccnncanctcagccagaatatccagagctatacatagcctgtaccagcagaagccnggccaagctccagttccngactctangactcggtacccagcgggccaactgacatccagancggtcagtggcagtgggtctagggactagtaccttcgaacttacgcctaatacctaatttcgacgtaagaacgtgggaactcctagaagtaacttttcgaactagttgtaatttacngtacacgctaacgtatggtaaacttctaacgtcctagttcgttacggacctaagggtaccgaaggtaagaattagaaaacgtacgtgtcggtactgacacgtagtacctcg

SEQ ID NO: 146838 - DNA, 621 bp, Homo sapiens
  misc_feature: GYAE6OF02FI3F1.21.4.A04.1.454.CMB.1.raw
  modified_base (147)..(147): a, c, t, g, unknown or other
  misc_feature (147)..(147): n is a, c, g, or t
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (408)..(408): a, c, t, g, unknown or other
  misc_feature (408)..(408): n is a, c, g, or t
  modified_base (444)..(444): a, c, t, g, unknown or other
  misc_feature (444)..(444): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccgganaattgtgtgacgcagtctccaggcaccctgtctttgtctccgaggggaaaccgccaccctctcctgcacgctccaggccctagaactactccagacgcctactacatacgcctggaccagcagaacgtccnggcccagcctcccgagttccnatctatcgactcggtaccagacggtccagtcggccacgtcccgagaccgtggttcgagttcggccgttagggcgttcgtaggggacctagaccgtttcactccgtaacntactaagtacgcaggtcgtacgcgcttagaacgttnttcgctagtagtacttcgtgtacagtactaacggtagtacgttacgttacctaccgtcgtttaacgtccgggttaccggaccggtaacgggaacgtaacggggtaactaaacgggtaactaaaaccgttacggttacgggtacgaccgttacgaccaaccgttacgtcccctttagg

SEQ ID NO: 146839 - DNA, 723 bp, Homo sapiens
  misc_feature: GYAE6OF02F2F10.21.4.A04.1.454.CMB.1.raw
  modified_base (531)..(531): a, c, t, g, unknown or other
  misc_feature (531)..(531): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggacgtttgggctgagcgttggttttcctgttagttatttacgaagtctcagtgtgaggtgcagtctggtaggagtcggtgggggataccgttggtcccagccgtagggacgggttccctaggacgtccttccgtcccgtggtcggaccacgccttactcggtactaattccctaaccgttgtaacggtacgaccctaacgaaccgtagttacggtccggtcgggtacccgacccgtacggccgtaccgggaaggggaaccgggtcgttaaggggcggtcggggtaccggtccgtaagttaaacggaaaggaaacgttctaaacggtgttaaaccgagtaaccgaaggtaacgtacgggctaccggtagtacggtaagggaaagtaccggtacaacctntaccgtagaaagtagtacgtaggtaacttaacgaaacgtaactcgtaacttgtaagtctaagtactaacgtagaaccaacgtacgaacgtaaacggcgacgtacgtacggtagttattaggtacggtaggttaacaaagtaaaggtagttacggaaggtttccggtagggtacttagggtccgtggtaaccg

SEQ ID NO: 146840 - DNA, 875 bp, Homo sapiens
  misc_feature: GYAE6OF02FTW95.21.4.A04.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagagtagtgatcaggggagctctgagagcggagccccagccccacgaattcccaggtgttttcatttggtgatcagcactgacacagaggactcaccatggagttgggctgagctgggtttttccttgttgttattttactaaggtgtcctagtgtgaggtgcagctggtggtagtctggggggagacgttggttccagccttgggaggggtcccctggacgactctacccgttgtgcgacgtcctctgtcctattctacccttctagttcgaacccactaaaccngttacgggaacttcgggtacccggtaccccgtaaggccggttaccgaacggggggtaaacgggggtcccgttggggaacgggttcgggggtccccggggtacgtacgttttaaacgaacgggaaaagtccgtaaaacgtacggttttaaacacgggtttaaaaccgagaaagtaacccgggtacgggtaccgttcggttagacggtaaaaacggggtaaggtttaaccgaacccttacgttaaccgtacgtaaaacgggaggttaacttagtaaagttaacctaaaaacggtaaaccgttaaccgtaccgtttaacggttaaactttaccgtaggttaccctaaaagttaacggtaaaccgtaaaacgtacccggttaaaccggtaaaaaccccggaaaccggtaaacccggtaacccgggttaacccggtttaaccgggttttataaaccggtttcggttaaccggggtaagtaaacccggttaaaaagggtacggtaacgggttaacgtagggtttaggggttcgggttaacggtaccggttaggttaaccggg

SEQ ID NO: 146841 - DNA, 738 bp, Homo sapiens
  misc_feature: GYAE6OF02GUWM7.21.4.A04.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggcctcacgaaacccaccggagaaattgtgttagaccgctaggtcctccaggccacccttgtcttttgctccgaggggaaacncgcccaaccctctccgtgcagtcctccgacgccgaagaatacgtaccgaggactacctactacagtaaccgtccgtacggtaaccagtacaaggtaacgcccgtgggacccctacgggtcccttaccccggtaacggtttccccacgtaacttccgtacgtcgttcccggtccgggtacccctaacggacgggtcccacggttcgccctaccgtacccgagaccgttggttcacggtggaccggtacggtcgggttaccgagggaacctaggttccttaccacgttcacgtacgttaccgtacgttacgctacggtaaacggcgaccggtacgtagggttaaacttccgttacggaacgttagtttacgggttacttgttccgtacggacgtccgtaaagggtcgtacgtaaccgttccacctttacggttcgtaaccgtccgtacgtaaccggacgtaaagggtacgtaaacgtaccggtaaatacggtagtaccgtacgacgtaccgtaacgtcgttacgtccg

SEQ ID NO: 146842 - DNA, 850 bp, Homo sapiens
  misc_feature: GYAE6OF02FSTJ3.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaggggaanactccaccctctcctgcagcctccagccaagaatactaccagacgactaactaactactacgccttacggtacccagaccaggaaacgtccgtacgggacccgaacggtcccttaccccggtagggtttccccttactacgttaccgtaagttcggtcccgttacgggggtacccccaacgggtaccggggacccctaacgggtccgggtaccctaaccgtccccgtaacggtaacccgttacgggtttaccgacgggttacggggacccggtaaggggtttaccggggttacggtacgggggtaaccctaagggttacccctttccggtaacccttcccgttaacgtacgtttacgtaagtttaccgacgtaacggtacggtacgggtaccgtaccgttaacggtaacgttacgttttaccggacgttacggtttacgttaacgtttacgtacgttaccgtaaggtacgtaaggttacgttaggttaaccgttccgtaccgttccgttacggttacccgggttaccggaacccgggttacggtaaccggtaaagggttaaacggtaaacggttaaccggtaaaccggtaacggtttacgggttacggtaccgttaccggacccgttacgtaccgtttacgtttaccgg

SEQ ID NO: 146843 - DNA, 713 bp, Homo sapiens
  misc_feature: GYAE6OF02GD91K.21.4.A04.1.454.CMB.1.raw
  modified_base (531)..(531): a, c, t, g, unknown or other
  misc_feature (531)..(531): n is a, c, g, or t
  modified_base (702)..(702): a, c, t, g, unknown or other
  misc_feature (702)..(702): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacgttgggtccagccgtggacgggtccctgagactctcctgtgcacgcctctgctacttcctaaccttcacgtcgaaccacgaaacagtaggacgtcgggtcccaccgacggtccgtaccggaggggaacggggcgtagggaggtcggggtcggccggtattaacggaaacggaaacgtacctaaacgtaacgttaacgaacgttaacgaaggtaaacgtacggcgtcgtactggtaaggaaggttaacgtccaactagttaccagaaacgagtaactagtaacttaacgaaaagtacctcgtaaacgtgtaacncggttacaacgtaaagtacgaaaccgtacgaaccgttaacggaaaaaccgggtacgacccggtaaccgtaccgtttaggttaacttttaggttacggtaacgggtaacggaaaacgtaaaagggtggttaaccggtaagttacggggttggggtttaacaggtttaccggngggttaacccg

SEQ ID NO: 146844 - DNA, 708 bp, Homo sapiens
  misc_feature: GYAE6OF02JLSO6.21.4.A04.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (402)..(402): a, c, t, g, unknown or other
  misc_feature (402)..(402): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagtctgggttttcctgttgttatttacaggtntccagtgtgaggtncagctggtgagtcgngggancttggtccagtcctgggacggtccctgacgtactcgtccgtgacgcagtcctcgagctattacccacttcagtcgaccacaacgtntgggacctgggtcccncgaggcctccggaggggacgggctgggtacgtcggggtacggccgttaataccgaaaggacgactaacgcgttacaagtacgagtaaacncggtcgtacggtctaggaaggaaacggttcgtccaaccgtntaccgtacggaacgngtagttaacggactttaacggaaattacctagaacgttggtaactcggtaagtacctaaaagtcgaaaccgtttacggaccttaaaccgggaaaaacgtcccgggtaaacgacccgggttaccgttaagtttaacgttttaccggggttgggtaaacggttaaaaccgaaaggttaaaacggttggttaaccggggtaagttgggttaaaccccggggtttcgggaacttacggggttattaacccgggg

SEQ ID NO: 146845 - DNA, 681 bp, Homo sapiens
  misc_feature: GYAE6OF02GV29N.21.4.A04.1.454.CMB.1.raw
  modified_base (555)..(555): a, c, t, g, unknown or other
  misc_feature (555)..(555): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctggagcgttgggttttccttgttgttattttacaggtgtccagtgtgaggtgcagcgtggtggagtcgtagggggatacgttggtaccagccgtggacgggtccctggacgtacctcctccgtggtcgccagtcccttcgtcgcctactttccacctttacacggtccgaaccaaccaactagtcggaccggtcggggtccccgaccgagggtccctaccgggaggggaacggggtcgtaggggaggtcggggtacggtaccgttaagtaacgaaaggaacgacctaaacgtacgttaacgaacgtacaaggtaacgtaccggcgtacgtcgtaggaacggaaagggtacgtccacctacgtctaacgaagagtatcgaattacgaaagtacctacgtactgttatacgtanaacgaatagaacctagaccgaacggaaaccgcggaaccgacggtaccgtgttattaggtttacgggtaagtaacgaaacgtaagggtaaggtggtagttgggtaggttagggtacgtcgtatacgg

SEQ ID NO: 146846 - DNA, 752 bp, Homo sapiens
  misc_feature: GYAE6OF02FZ9BR.21.4.A04.1.454.CMB.1.raw
  modified_base (168)..(168): a, c, t, g, unknown or other
  misc_feature (168)..(168): n is a, c, g, or t
tcagtcgtcgctcgcacgaccggtgctcgatttagagtagtgatcagggggtagctctgaagagcggagccccagccccaagaattccccaggtgttttcatttggtgatcagcactgaacacagaggactcaccatgggagtttggctgagctgggttttcttgttnttatttacaggtgtcagtgtgaggtgcgagtcgtgggtggagtcggtgggggagtacttgggtccgaggtccgtgggtacgggtccctggacgtcctcgtccgtagtgcacgcctctgctattcctaccgttcgacggtacgaccacaacgtagtaggaccgttcggggcccgtaccgacggtccgtaccggaggggaacggggtccgtagggtacggtcggggtaccggtaccgtaagttaaaccgaaaggtaaacgaacgtaaacgtacgttaaccgaaggtaaccgaaggtaaaccgtacgggaccgtaccggttacgtaggtaaacgggtaaaacgggttaacggttaaccaacttaacgttcctaacggaaaggtacgtaacgttacgtaaacttaacgaaaacgtacctaccgttaatacgtatccgtacgaactaaagtacgactacggaccgtaacgaaaccggacggaacgtacggtaccgttagtttagttagttacggttaacggtaacgtaaacgtaaacggttggttaaggtagttacggggttaggaggttaccgtcggtacgtaaccgg

SEQ ID NO: 146847 - DNA, 765 bp, Homo sapiens
  misc_feature: GYAE6OF02G51J6.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaanacgcccaccctctcctgcagctccagccaagaatactaccaagacgtactaactacaagttacgtccgtacggtaacccaaggacaacggtaaacgccgttacgggacccgaacggtccctaccccgtacggtttccctacgtattacctaagtcgtccgttacgggaccccctaaggaccgggcccaacgtcgggacctactccccgaagtacctaggttaccaggttacggacgtagggttcgggtacgtaggggaactacgtaccttaccacgttcctaacgtactacgtaacttacggcgtaacggtacggtaggtacggtaccctaggtaacgttacgttaccggtacttaggttacgttaagtttaccgtcgtaaggtacgtaacgttaacgttacggtaacgggttaacgttacccgtacgtttacccggttaggttacccggttaccggtaaccggtaacgggtaaccggtaaagggtaacggtaaacgtaacggtaaaccgttacgggttacgtaacgggtacctaccggactaaccgtacgttacgttaccgg

SEQ ID NO: 146848 - DNA, 703 bp, Homo sapiens
  misc_feature: GYAE6OF02G8JVE.21.4.A04.1.454.CMB.1.raw
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
  modified_base (504)..(504): a, c, t, g, unknown or other
  misc_feature (504)..(504): n is a, c, g, or t
  modified_base (685)..(685): a, c, t, g, unknown or other
  misc_feature (685)..(685): n is a, c, g, or t
tcagtcgtcgctcgcacgaccggtgctcgatttagagtagtgatcagggggagctctgagagcggagccccagccccagaattcccaggtgtttcattggtgatcagcactgaacacagaggactcaccatcggagtttgggctggagcgttgggttttccttgtgttattttacaggtgtccagtgtgaggtgcagctggtggagtcgtgggganacgttggccagtcctgggacgggtcctaggacgacgtctccgtgtcggcacgcccttgnacgttaccttaccctctacgtacgtaccaaccgtaacaagtacgttaacggtccgggtccggttacccgacggtaccggtacccgtaaccggggaaggggtaccgggtaggttacggggtacgggttacccggggtccgggtaacccgttaaagttaaacgggaaaacgtacggttaaactaacggttaaccgagtttaacgaaacgtaacgaacggtccgtaacggtntacggtaggaaagtaaggtaccgtacacgtactactaagagagtatagtaacaagtacactacactatactagagtaacgtaagaacgacgtaacgacgtaaacaacgggtaaccacggtaccgggtacttagtacgttagttacggtaaggaacgaaaggtagtacgtaggaggttaggnggttagagtcggagtacg

SEQ ID NO: 146849 - DNA, 794 bp, Homo sapiens
  misc_feature: GYAE6OF02G83XB.21.4.A04.1.454.CMB.1.raw
  modified_base (553)..(553): a, c, t, g, unknown or other
  misc_feature (553)..(553): n is a, c, g, or t
tcagtcgtcgctcgcacgaccggtgctcgatttagagtagtgatcaggggaggctctgagagcggagccccagccccagaattcccaggtgtttcattggtgatcagctactgaacacagaggactcaccgatggagttgggctcgagtcgttgggttttccttggttagttattttaaccgaaggtcgtcctaggtgtaggtaggtcgcgagcgttagggtggtacgtcgtcgggggaatcggttacggtcacggtccggtagggtacggtcccgtaggtacggtaccttacccgttccgtggttcggacctaccgtcccgtgtcggacctaactttccgtacccgtttgacggttaccaacccctaagtaaacgtacgttggaccggttaccgggtcccgaccgtaacggtcctaccgggaaaggggaaccgggtccgttaggggaacggttcggggtcccgtaacgttacgttaaacggaaacggtaacgtaccgttaaactacggttaaccaggttaaaccaagggtaacgtacggccgtacgttacgnggaacgtaaacggacgtacgaactagtacgtagaagaacgatacgtaacgtacgaaaaggtaacctacgtaaacttcggttaataccgtaacgaacgttaaacgacgtaacgtaaccgtaaccgtaacggaaacggacgaacgtaaccgacgttacgtagttacggttaggtaacggtaacgtaacgaaaacgggtgttaaggacggtacggtaggttacggtacggtacgttacggaacg

SEQ ID NO: 146850 - DNA, 689 bp, Homo sapiens
  misc_feature: GYAE6OF02GK7R5.21.4.A04.1.454.CMB.1.raw
  modified_base (147)..(147): a, c, t, g, unknown or other
  misc_feature (147)..(147): n is a, c, g, or t
  modified_base (540)..(540): a, c, t, g, unknown or other
  misc_feature (540)..(540): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccgganaaattgtgttgacgcagtctccaggccacctgtctttgtctccgaggggaaagacgccaccctctcctgacacgctccagccacgaatactccgagagacctactaacataccgccgtacggtaccagacaagaacgccgtggaccctacggcctccccggtacggtttcccacgtacttccgtatacggtcggtacgggtacccctaacggacggggtcccacggtcggcctaaacgtccccgaaggtaccgtaacggttccgaggttcggcgttaggtcggtgtacggacgtaacgtaccttcgactcgtactacttactaagtacgacgacgtacgtcggtacgtcgtaaggtacgtcttacggtcgtagttacgttattacgtcgttanacgtacgtacgttagttagttaacgttaccgttccgtcgttcggtaccgtttacggaccggtacggtaaccgttaacgggaagtaaacgttacggtaaaccgtagttaggtaacggtcgtacgtactaaccgttacgtacgtttaaccg

SEQ ID NO: 146851 - DNA, 813 bp, Homo sapiens
  misc_feature: GYAE6OF02I9ZKP.21.4.A04.1.454.CMB.1.raw
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
tcagtcgtcgctcgcacgaccggtgctcgatttagagtagtgatcagggggagaagctgctcagttaggacccagaggaaccatggaaaccccagcgcagcttctcttcctctgctactctggctcccaggctcaagaaacccaccggagaaacttgtcgttgaccgctagtcctccaggtccacccgtgttctttaggctacgaaggggaacncgcccacccgtctccagccagcctaccgngaccaagactacgtccgaagacctactacactactaccgccttaggaccagacaggaacgcctggaaccgcggtacccttccccgtaaggtttcccaacgtacttcgttacgccggtacccgtacgggtccccctaacggtacgggtacccctaaggttccggacccgtaccgtaacccggacgttaaccggtacgtttaccggaacggggtttcgaccggttagggttccgggttacgaagggaaaccccttggttacccgtttacccaacccggtttccaacggtaactacgtaaacgttcgaaccggtaacggttacgtaccggggtactaccgttaaggaacgttacccggttagtaaccggtgttaaccgttacgttcgtacgtacgtaccggtagttaacggtaccgttacggtaaccctttccgtacctttcgggtacgtttaacccggggtaccgtaacgggaccgtaacggttaaaccggtaacggtaaacgttaccggtaaaccggtcgtttacgggtacgtaccggtccgtaaccgtaacccgttcgttaccgttaccg

SEQ ID NO: 146852 - DNA, 784 bp, Homo sapiens
  misc_feature: GYAE6OF02HJAO7.21.4.A04.1.454.CMB.1.raw
  modified_base (202)..(202): a, c, t, g, unknown or other
  misc_feature (202)..(202): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcacgaaaccaccggagtaaattgtgttgacgcagtctccgaggccacctgttctttgctccgagggaancgccacctctcctgctagcctccgagccagaatactccaaggacncttaanacaatacgtccttacggacagacaaggacgccgtacggaccacggccctacccgacgggtttccctactaacttccgtaagtcgtaccgttcgggtaccccagggaacgggccctacgtcgggacctacctacgaacgacgtacggtttacgaggtacggacgtacggggtcggttacgaacggggtactaacgtaccttacgacttcctttaacgacttcgtaaacgttacgaccgtaacgtaccggtagggtaccttaaccggttaacggtaacgtttaccgtttaccggaaacgttttggttaacgtttaaccgtttacgttcggtaaccttaacggaaccgttaaggtttaacgtaaccggttaacggtttacctaacccggttttccggtacggtttcccgggtaacccggtaacggtaaaccgggttaaaccggtaacggttaaaacgtaacggtaaacggtaaacccgggttaagtgggttaccggtcgtaacggaccgttaaccgttacgtaccgtttaccgg

SEQ ID NO: 146853 - DNA, 725 bp, Homo sapiens
  misc_feature: GYAE6OF02GNY1J.21.4.A04.1.454.CMB.1.raw
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttccttgttgttatttacgaaggtgtccagtgtgaggtgcagcgtgggtggagtcggtgggggacgtacttggtccagtccgtagggacgggttcccngacgtactctaccgtgtcgcacgtccctntgctattccaccttcgagtcaacccaacaactntggacgtcgggcccnccggagcctccggaaggggaacgggctaggggagtcggggtaccggtaccttagtaacggaaggaaagcctaatagttaacagttaacgaaggtaacgtcggctcgttaggtacgtaagggaaacggtacggttaccaacctaagtacgtaaccaaaggtaacgtacgtagttaactaaccgaaaaagttccctaccgtaaagttccgtataccgtataacgaacgttacgaaccagtaacccgtaaacgggaaaacccgtacgggaaccgtaccgggtacgttaacggttacttgggttaaccgttaaagggtaaacgtaaaaccggtaaaggtaacgggttgggaacgtttaggggtacggggttaaggtacggtaccggttaggttaaccg

SEQ ID NO: 146854 - DNA, 745 bp, Homo sapiens
  misc_feature: GYAE6OF02HA3RM.21.4.A04.1.454.CMB.1.raw
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
  modified_base (679)..(679): a, c, t, g, unknown or other
  misc_feature (679)..(679): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcctacccgtgttcctttgtcctcgaaggggaaanctcccaccctcctcctgccagtcctaccncgaccaagtaactactaccaaggtacgtacctaactaacaattacggaccgttagggtaaccagtacaaggaacgtccgtggaccgacggcctacccgtacggtttccctacgattacctagtccgtaccgttccgggacccacggacggtccacgtcggacctaccgtcccgaacgtcggtaccgtagtacggtcgggtaccgtagggttcccgggttagacggggtactaacgggttaccttccgtaacgtcctaacctagttactaattaccggacgtaacgtacgtacggtacgtaccgttaaggtaacgttacgttccgtacgtgtttaacgttacttcgtgtaccgtattacgtaacggttctaggttaacgtaccgttaccgttcgttccggtacggttaccgggaaccggtaacgggtaacgtaaaacgggttanaaaaccggttaaggaacgttacggttcgtacggtacgtaccgtacgaaccgtttaggtccttccgg

SEQ ID NO: 146855 - DNA, 852 bp, Homo sapiens
  misc_feature: GYAE6OF02F08FP.21.4.A04.1.454.CMB.1.raw
tcagtcgtcgctcgcacgaccggtgctcgatttagagtagtgatcaggggagagctgctcagttaggacccagagggaaccatggaaacccagcgcagcttctccttcctcctgctactcgtggcctcccgaggctcaagaaccgaccggagtaaattgtgttgaccgctagtcctaccgaggccacccttgttactttgtcctaccggaaggggaaacgtcgcccaccctctctacgctacgtccctacgagcccaagtaacttacgaccgagtacgactaactaacgtacttacggtacccttacggaacctacggaccgtaaaggaccgtccgacgggtacccgaccggttcccgtaccccgtacggttttccctacgtacctttacgtacggtaccggtccggttacccggtcccgaacggtaaccggcccctaagggtccgaacccgtacgtaccccgaaggtaaccggttacggtaccgtagggtccggtacggtacgggttgggttaccggaaccggtaacgtacggttacccttaaccgttaccgttccgttacgtaacttaacggttaacttaacggacgttaggttaacccggtacggggtaccgacgtttacgggtaaacggttccggtttaagcggtttaacggtttaagtttccgttacgtacgttacggtacgttaaccggtaagttttacgtaaacggttaacttaccgggttctttaccggtccgggttacggtaccgggtaaccgtaacgggtaacggtaaggtaaacgtaacgaaaaccggttaccggtagttccgtaggttacccgacggtacgtacgtaccggttgttaccg

SEQ ID NO: 146856 - DNA, 784 bp, Homo sapiens
  misc_feature: GYAE6OF02IG803.21.4.A04.1.454.CMB.1.raw
  modified_base (695)..(695): a, c, t, g, unknown or other
  misc_feature (695)..(695): n is a, c, g, or t
tcagtcgtcgctcgcacgaccggtgctcgatttagagtagtgatcaggggagagctgctcagttaggaacccagagggaaccatggaaaccccagcgcagcttctcttcctcctgctactctcgctccagctcaagaaaccgaccggaagaaacttgtgttacgacgctagtctaccgagccaccgttgttctttgtccgtacgaacggggaaagtactccctacccgtcttccgtacgccacgtcctaccgacgtaccgaagtaactactcccgtagtacgtacttaaccttaaccgaagtaccggtaccgttacggtaacccgacggtaccgtaaaccggtaaccgtacccgttaccgggacccgtaaccggtacccgttcccggttaacggtttaccccttacctaaccgttacgttacgttcggacccggtttaccgggtaaccccgaacgggtacggtacccgtaccggttcgacctacccgtacccgaacggtaccggttaggtaccgtacgggtcggaccggtagggttaccggttacggaacggtaaccgtaacgtaccgttaccgaccttactacctaagttaccttaagtaccgaacgtacgtacgtaaggtacgtaccgtaagtacggttacgttcgaattacgttagttacttctagtccagtgtacgttagacttcgttacncttagccggttacgtacgcgaacggaccgtaaggtaacgacctaaagtacccgagttacggcgtaccaccgtaccgcttacgtctaccg

SEQ ID NO: 146857 - DNA, 704 bp, Homo sapiens
  misc_feature: GYAE6OF02HS47B.21.4.A04.1.454.CMB.1.raw
  modified_base (203)..(203): a, c, t, g, unknown or other
  misc_feature (203)..(203): n is a, c, g, or t
  modified_base (528)..(528): a, c, t, g, unknown or other
  misc_feature (528)..(528): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggccaccctgtctttgtctccgaaggggaaanacgcccaccctctcctgcagctccagaccagaatatcccgaagacgcttactacattacgccttaggaccaagcgaagtaacgccgtcgggaccaagggccctacccgtaggtttcccactaacttcctaagttcggccgttaccgggtaccccaacggacgggcccaacgttcggaccaaccgtacccgaaggtaaccgtaggttccgaaggtcggaccgtagggttcgggtacgtacgggaactacgtacttcgactctaccgaatcgtaattacgacgtagtacgtaggactacgtagaacgtttacgttcgacttacgttnttaacgttactgtacgagttaccgtaagttacggtagtaccgttacctaccgtttcggtaccggttaccggttacccgggaaccgttaacgggtaaccgtaaaggtaaagtaaaccggtaagtaaaccgtacgtggtaccggttacaacggtacaacccgttagttaccgttaccg

SEQ ID NO: 146858 - DNA, 816 bp, Homo sapiens
  misc_feature: GYAE6OF02JCLI9.21.4.A04.1.454.CMB.1.raw
  modified_base (657)..(657): a, c, t, g, unknown or other
  misc_feature (657)..(657): n is a, c, g, or t
tcagtcgtcgctcgcacgaccggtgctcgatttagagtagtgatcaggggagctctgagagcggagccccagccccgagaattcccaggtgttttcatttggtgatcagcactgaacgacagaggactcaccatggagtttgggctgtagtcgttgggttttccttgttgttaattttacgaaggttcgtcctaggtggtcgaggtgctacggcgttgggtggtaacggtcggtaggggggtagtacgtttcgggtacccaggccggttacgggaaccggttcccctaggacggtaccttcgtaccgtcgtcggtccgtacgtcccgttcgtaggtcctaaccgttttcccgaacctttaccgagttaccggaaacccacgtaacggtacgtcggtacgtcgggtacccgacgtacggtccgtaccgggtaaggggacggggtctcgggtacggttcgggtaccggtaaccgttaagttaacggaaaacgggtatcctaaaacggttcggttaacctaggtaacgtaacgaacgtccggggtaccgtcgttacgaaggttaagggaaaccgtacgtacaccgtagtaccagtaaaggtacaggttactaacgttaacgaaagttacctacgtaaccgttataacgtccccggtaaanaaacgtaagttacccgaaacggtaccgtaaaccggtaacgggaaaaccgtcgaaccgttaaccggtaccgtttaagtacgtttaggccgtaaggtaaacgtaaacggtacggacggttagtacgggttcgggtagtacggtacgtacgtacggtaaccg

SEQ ID NO: 146859 - DNA, 700 bp, Homo sapiens
  misc_feature: GYAE6OF02I3BLS.21.4.A04.1.454.CMB.1.raw
  modified_base (201)..(201): a, c, t, g, unknown or other
  misc_feature (201)..(201): n is a, c, g, or t
  modified_base (318)..(318): a, c, t, g, unknown or other
  misc_feature (318)..(318): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttagacgcagtctccaggcaccctgtctttgtctccgaggggaanacgccacccgtctcctgacagcctccacgaccgaagaatactccgagacgtctactacatacgcctaggtaccagcagtaacgccgtacggccaggtccgtacccgtaggtttcccncgtactctagtcgccgtaccgggtacccacggaccggcctacgtcggacctactacccgaaggaccgtaggttaccgagggtcggaccgtacgggtgggtaccgtacgggacctaaggttaccctcgtaaccgttcctacgacgtactacgtttaacgacgtaacggtaccggtaggtaccgtacccggtaggtaaaccgttacgttacggtacttacgttacgtttaacttacgttccgacgtacgtacgtagttagtagtacgttaccgaccgtttcgtacgttaccggtacgtaccggtaggtaaccggtaaggtaacgtaacgtaacggtaaaccgtacgtacgtacgtacgtacgtacctaacgtcgttacgttacg

SEQ ID NO: 146860 - DNA, 791 bp, Homo sapiens
  misc_feature: GYAE6OF02GMJ0M.21.4.A04.1.454.CMB.1.raw
tcagtcgtcgctcgcacgaccggtgctcgatttagagtagtgatcagggggagctctgagagcggagccccagccccagaattcccaggtgttttcatttggtgatcagcactgaacacagaggactcaccagtggagtttgggctgagtcgttggggtttttccttgttgtttattttacgaaggttcgtccaggtgtaggaggtcgcgagcgttggtggagtcggtgggggatacgttggtccaggccgtgggacgggttccctaggacgtacctcctccgttggtgacctacgtcccttctagactacttccctacctttggacgttcgaaacccctaacaacgtacgttcggggtaaccgttccggggcccctaccggaacgggtccgtaaccgggaagggggtacgggccgtaggggtacgggttccgggtaccggtaaccttaaggttaacggaaacggtaagtaccgtaaagtacgttaacgagtacgaaggtaacgttaccgggcgttaccggtacgtttagggaaacggttaaacgggtacggttaccaaccgttagtacctacggaaagtagattacgaacgttaaaccaaagaccttacgtaacgttacgtagtacctagggaactaacggtaacgtaacccgaacgtaaacccgtaaacgggaaccggtaaccgacccggtaaccggtaccgttaggtttaacgttgtaaggtacgggtaaacgaaacttaaagggttggaggttacgttggggtaggttacggagttcggatacccgg

SEQ ID NO: 146861 - DNA, 761 bp, Homo sapiens
  misc_feature: GYAE6OF02IZMFK.21.4.A04.1.454.CMB.1.raw
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
  modified_base (537)..(537): a, c, t, g, unknown or other
  misc_feature (537)..(537): n is a, c, g, or t
  modified_base (723)..(723): a, c, t, g, unknown or other
  misc_feature (723)..(723): n is a, c, g, or t
  modified_base (734)..(734): a, c, t, g, unknown or other
  misc_feature (734)..(734): n is a, c, g, or t
tcagtcgtcgctcgcacgaccggtgctcgatttagagtagtgatcaggggagctctgagagcggagccccagccccagaattcccaggtgtttcatttggtgatcagcactgaacacagagactcacatggagttggctgagtcgttgggtttccttgttgttatttacaaggtgtcctagtgtgaggtgcagctggtggngtcgtggggatacttggtccagtccgtggacgggtccctggagtactcgtaccgtgtcgcagtcccgtngtcattcctaccgttagacgtcgaaccgacaaactagtcggtaacggttcggggtaccccgaccgtagggtcccgtacccggtaaaggggggtaaccggggtcctagggggtacggttcggggtcgggtacccgttaagttaaccggaaaggtaacgaaccgttaacacggtttaaccaacggtaacgtaaggtaaaccggtaccggccggttaccgttacgtaacgggttaaagggaaaccggtaaacggtttaccgaaacccgtntttaaccccggagtaaaacgggtagtaaccgttaggtaaattaacccgaaaaaggtcccctagaaccgttagttaaccgtcgtacgtaactaaaggtaccaaccgaacgtacgtaaccggaaacggtcgaaaccgtacgggtactaggtacttaggttagtaccgggtaaaccgaataaaccgggntacgggtaacnggttagggtagacgcgttaggtaaccg

SEQ ID NO: 146862 - DNA, 832 bp, Homo sapiens
  misc_feature: GYAE6OF02IKTT8.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctgctccaggctacagaaaccacggagaattgtgtgacgcagtcctacaggcctacctgttctttgctccggaaggggtaaanccgccctacccttctccgtcgacacgtctaccgacgaccgtagaactactaccgagtacgaccttaacactactacggtccgttacggaacccagtaccgaacggtaaccggtccgtacgggaccctacgggtccctaccccggtacggtttccctacgtacttaccgtacgtcggtaccggttccgggaccccaacgggtccgggtcctaaccggtcggtaaccctaccgtacccggtaaggtaccggttaacggtttcgacgggttaccgggtaacgtcggggtaaccgggttcggttaacggaaccgttacggtaacccttcggtacccttccgtaacgtaaccttacgtacgttaacgaccggtaacggtacgttacggaccgtcgttaaggtaacgtttcgtttacgacggttacgtttacgttacgtttaccgagtcgaacgttagtaacggtttacggtaacgtaccgtttacgaccgtttacgttaccgggtttaccgggacggttaaccgggtacggttaaccggtaacgggttaaacggttaaaccggtacggttaaacccgggtagtttacgggtacccgttaggttaccgaacccgttacgttccgtttaacgtccg

SEQ ID NO: 146863 - DNA, 734 bp, Homo sapiens
  misc_feature: GYAE6OF02IQ7OH.21.4.A04.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattggtgttgacgcagtctcaggcaccctgtctttgtctcgaggggaagngcctacctctcctgcacgctccacgaccagaatactccaggacgcctaactacatacgccgtggtaaccagacaacgaacgcctgggccctacggcctcccgagggtttcccnctattcgtatcggccgttcggggtaccccacgcgggcctacgtcggaccacgttcccaaggtacctagggttccagggttcgggaccgtagggttcggggtaccgtaggggaaccctacggtaacccttttccgacccgtttcctacttacgttactaacgtttaccggacgtaacgtaccggtcgggaacgtccgtagggtaaacgttatttccgggaacgttagtttacgttatttaccgtacgtacgtacgtcgtaacgtttaggtaacggttaacgttccgttacccgtttggtcgggttaccggtaccggaacggtaaccggggtaacggttaaggtaaacggtaacggttaacggaaaccgttaggttaccggtacggtacctccggtaaccgtaccgttagttacccgttcgg

SEQ ID NO: 146864 - DNA, 696 bp, Homo sapiens
  misc_feature: GYAE6OF02F9T7P.21.4.A04.1.454.CMB.1.raw
  modified_base (245)..(245): a, c, t, g, unknown or other
  misc_feature (245)..(245): n is a, c, g, or t
  modified_base (689)..(689): a, c, t, g, unknown or other
  misc_feature (689)..(689): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctaccgaaggggaaagcgcccacctcctcctgcagcctaccacgaccaagaaattacncccaagacgtactaaccgtacaatacgacctcggtaaccagaccaagaacggtcctcggacccgaaggtcctaccccgtaacgggtttccctcgtacgttactaacgttcgaccgttccgggtacccaacgacggggccctaaacgttcgggacctacctacccgaaggaaccgtaggtttacgagggtacggaccgtaaggggtttcgggtcgtaaggggaacacgggtttaacctccggtacctacgtactaactctaacgttacacgtagacgtggactacgtagtaaacgtcgttcgacgtagttagttaacttactcgtacgagtagtaagttgtaacgtacttacgttaacgtcgttagtaccggttacgaaccggtaacggaacgtaagtaagtaaaccgagtaacgagttcgtagtactaccggacacgtacgttntaaccgg

SEQ ID NO: 146865 - DNA, 764 bp, Homo sapiens
  misc_feature: GYAE6OF02F4QKJ.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactctggctcccaggctcaagaaaccaccggagaaattgtgttgacgcagtctccgaggcaccctgttctttgtctaccgaggggaagacgcccaccctctcctggcagcctccagccaagaactactaccaagacgacttaactacagtacgccttggtaaccagacgaagacgccgtcggaccgacgggtcctaccccgtaggtttccctacgtacttactagttcgtccggttccggggtaccccaacggacggggtcccacgttcgggacctaaccgtccccgaaggtaccgttacgggttaccgagggttacgggacgtacggggtttcggggttaccggttacggggaaacttacggtaacccgtttccgtaacctttccgtcgttaacttacgtaacgtttaacggaccgtaacgggtaacgttagggaccgttaccgtaaggtaacgttacgtttcgacgtagtttacgttacttacgtgtacgacgtacgtagtaacgtggtaacttccgtacgttcgttaggttaccgttacgggaaccgtacggtaaccggtaaacgggttaaagtaaacggtacggtaaaaccggttacgttacgggacgtaccgttacggaccgtacgttagttacgttaccgg

SEQ ID NO: 146866 - DNA, 747 bp, Homo sapiens
  misc_feature: GYAE6OF02HBJWT.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaagngccaccctctcctgcagcctccagccagaatatcccagacgctaactacatacgcctaggtaccagcaagaacgccgtggaccaggcctcccgtacggttccctacattacgtatcgtccgttacgggtacccccacggacgggacccaacgtcggacctacgtaccccgaaggaccgtacggttaccgagggtcggcgtaaggtttggggtaccgtaggggtaacctacggtacccttacgacctttcgtacctaacgttactaacgtttaacggaccgtaacggtaccgttaggggaccgtacccgtaggtaaacgtaccgtttacggacgttaggtttagttaacgtttaacgttacgtacgtacgtacgtaaggttacgtaagggttaacggtttaccttacccgtttcgttccggttaccggttacggtaacccggtaacgggaaccgttaaaagggtaacaaacggttaaccggtaaaccggtaaccgttagggtaaccggtacgttaccggaccgtaacccgttagttcccgttacgg

SEQ ID NO: 146867 - DNA, 816 bp, Homo sapiens
  misc_feature: GYAE6OF02G7TYH.21.4.A04.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcagaaaccaccggagaaattgtgttgacgcagtctccgagccaccctgtctttgtctaccgaaggggaanacgccctaccctctcctagcacgcctccacgccaataacgtanccgaagacgtcctaacctacgatacgccgtacgtaaccagacgtaacggaacgtccgtcggcccgaccggtacccgttccccgtacgggttccctacgtactccggttacgtcggtccggttacccggggtaccctaacgggaccgggtacccgtacgttacgggcctaacccgtaccccggaagtaacccggttacggttccgaacgggtcggtacggtacggggttcgggtccggtacggggtaaccagggtttacccttacctaccgttaccgtaccgttaagtaccttaacgttaacggtaacggtaaaccggtacggtttaacgggtaccgtaccggttaaaggtacgttttaaccggtaccgggtaccgttaaggttacgttttaaaccgttacgtacggtacgtacgtacggtaacgttaacgggtaacgttaacgttacccttcgttacggttccgtaccggttcggaacccggtaggttaacccgtaaaggtaacgttaaagaacggtaaagttacgggtacgtggacccttaggaacccgtacgttagttcccgttacg

SEQ ID NO: 146868 - DNA, 731 bp, Homo sapiens
  misc_feature: GYAE6OF02HUQH2.21.4.A04.1.454.CMB.1.raw
  modified_base (236)..(236): a, c, t, g, unknown or other
  misc_feature (236)..(236): n is a, c, g, or t
  modified_base (354)..(354): a, c, t, g, unknown or other
  misc_feature (354)..(354): n is a, c, g, or t
  modified_base (531)..(531): a, c, t, g, unknown or other
  misc_feature (531)..(531): n is a, c, g, or t
tcagtcgtcgctcgcacgaccggtgctcgatttagagtagtgatcagggggagagctgctcagttaggacccagagggaaccatggaaaccccagcgcagcttctcttcctcctgcctactcgtggctcccaggctcgaagaaacccgaccggaagtaaattggtagttgacgacagtcctccaggcctaccctgtcgttttgtccgtccgaaggggaagcctccctacccgttcncgtacgcgtacgcctaccacggaccaataacgtactacgagtaccgacttactacacgtagcctaggtaccgagacgaagaacgccgtcggcgtacggtccctaccgacggttacccncgtaactgtactcggtcccggtccggacccacggcggtaccctacgtcgggacctaccgtaaccgacgtaacggtacggttacgaggtcggacgttaggggtccgggtaggttacgggtaacctaaccggttacctaccgtacttaccgtcttaaccgggttaactacggttaaccncggttaaacgtacggtagggtaaccgtaacgtagtaaccgtttagtaccggttaacgttaggtacgttagttaccgtgtacgtaagtacgtaggtttacacggttacgtccttcgtcgtcggtacgttcgggaacgtacggaacgtaggtaaagaacgtacggaacgtagtcggtctacgcgaactacgtcgtagttacc

SEQ ID NO: 146869 - DNA, 718 bp, Homo sapiens
  misc_feature: GYAE6OF02ISQT3.21.4.A04.1.454.CMB.1.raw
tcagtcgtcgctcgcacgaccggtgctcgatttagagtagtgatcaggggagagctgctcagttaggacccagaggaaccatggaaaccccagcgcagcttctcttcctcctgctactctggcctcccaggctcagaaaccaccggagaaattgtgttgacgcagtcctccaggccaccctgttctttgtctccgagggaagcgccaccctcctcctgcacgtctacccacgtccaagaaactacgtaccaagaccgtactaactacatacgtccgtacggtaccacgtacgacgaacgccgtcggacccgtacggcctcccgtacggttacctacgtacgttccttagtcggtcggtccgggtacccgaccggacgggtaccctaccgttcggtacctaccgtacccgaacgtaacggttaacggttaccgaggttcggacggtaggtcgggttcgtagggtaacctagtacctttacaccttcctagtactacgtaacgtacgtacgtacggtacggtacggtcgtaccgttaaggtaacgttacgttacgtacgtagttacgttacgtttaacgttacgtacgtagtaccgttaggttaacgtagttaaccgttcgtactcttacggttccgtacggtacggacgtaaggtaacggtaaggtaacgtaacgtaaacggtacgtacggtgtctaccgactacccgtagtacttacg

SEQ ID NO: 146870 - DNA, 821 bp, Homo sapiens
  misc_feature: GYAE6OF02JC317.21.4.A04.1.454.CMB.1.raw
  modified_base (148)..(148): a, c, t, g, unknown or other
  misc_feature (148)..(148): n is a, c, g, or t
  modified_base (310)..(310): a, c, t, g, unknown or other
  misc_feature (310)..(310): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccacgganaaattgtgttgacgcagtctccgaggcaccctgtctttgctccaggggaaatgccacctctcctgcagctccagccagaatatccagtagctacgtacactacgccttggtaaccagccaagacgcctgggaccccaggtcctacccgtaaggtttcccctnaacttcctaattccggtaccgttccgggggtacccccaacggtacggggtaccccaacggttgggccaacgttacccccgaaggaacccgtagggttttacccaaggtttcgggactaacgggggtttcgggtaccgttcgggggaaactaaccgggtacttttacccggacccgttacgttaacccgtattacgtaacgtttaaaccggtccgtaaggtacccgttaggggaaccggtacccgttacgggaaaggtttaaccgttttaccggccgtaaacggtttacggtttaactttaaccgttacggttacgaacgtaccgtaacgggttaatacgggttaaacgttttacccgacccgtttacgttcggttaccgggtttccggaaccgtaaggggtaacccgtaacggggttaaacggtaaaaccgttaacggtaaaaccgtaacgttacgggttaccggtacgttacccggtacccgtaacccggttacgttacccgtttaccgg

SEQ ID NO: 146871 - DNA, 960 bp, Homo sapiens
  misc_feature: GYAE6OF02F7ZY2.21.4.A04.1.454.CMB.1.raw
tcagtcgtcgctcgcacgaccggtgctcgatttagagtagtgatcgaggggagagctgctcagttaggacccagaggaaccatcggaaaccccagcgcagcttctccttcctcctgctactctggcctcccaggtctacaacgaaaccgaccggaagtaaattggtgttagaccggctacgtcctaccgacggcctacccgttgttccttttcgtccgttaccggaagggggaaacgccgtacccctaccccgttccgttcccgtcgaccgacgtccctacccgaacgaccctaaagtaaacttaccgtacccgaacgaacgtacccttaaaccgtaacgtaccgttaaccggtcccgtaaccgggtacctaaacggaacccgtaaacggaacccggtcccggtccgggaacccgaaccgggtcccctaccccggtacggttccctaacgttaacttaccgttaccggtccggtacccggttaccgggtaccccgaacgggtacccgggtaccctaccgggtaccgtaacccaaccccgtacccgaacggtaccgtacgggttacccacggggtcgcggttacggggtcggtacggtacgggaacctacggttacctaccgtaccgttacctacgacgtaccgttaactcggaacgttacggtaccggtaggtaccgttaccgtaaggtaacgtttccggttacgtaccggtttacgttacggtttaccgttacgtacttaccgaacggttaacgttaggtttaacgggtaccgtttaacgtttacccggtaccctttcgggttaacccgggttccgggttaaacccggaaccggggtaacggtaacccggtaaaaggtaaccgtaaaccggggttaaaccggtaaaccggttacccggttaggttacccgggtaacccgttacgtaacccgtaacccggttctttaccgggttaacccg

SEQ ID NO: 146872 - DNA, 801 bp, Homo sapiens
  misc_feature: GYAE6OF02HUUJ4.21.4.A04.1.454.CMB.1.raw
  modified_base (108)..(108): a, c, t, g, unknown or other
  misc_feature (108)..(108): n is a, c, g, or t
  modified_base (152)..(152): a, c, t, g, unknown or other
  misc_feature (152)..(152): n is a, c, g, or t
  modified_base (213)..(213): a, c, t, g, unknown or other
  misc_feature (213)..(213): n is a, c, g, or t
  modified_base (758)..(758): a, c, t, g, unknown or other
  misc_feature (758)..(758): n is a, c, g, or t
tcagtcgtcgctcgcacgaccggtgctcgatttagagtagtgatcgagggggagagctagctcagttaggacccagagggaaccatggaaacccagcgcagcttcctntcctcctgctactctggctcccaggcttcagaaaccgaccgganaaacttgtcgttagacgtcagtactcccaggcaccctgtacttttgcctacaggggaaacncggtcctaccctcgtaccgagccaggtctcccagcctaagtaactacttaccagacgttctaactactacgagaccgttacgtaaccgacgacacggttaacgccgttacggccgaacggtccctacccgtaacgggtttaccctaccgtaacggttacttaaacggttccggaccgggttaccggggttaccccgtaacggaaccggggggccctaaaaccggttccgggtaccctaaacggtacccccgaaggtaacgtacggttaccgacggttacgggactacgggtacggtcgttacgggacctagtacgttacaacgtttcgtacactacgtattacgtacgatacgacgacggttcctaggtaactagttccggatacgtacgtttacgtacgtagtacgacgtacgttaacgtagtttacgggtaacgtaccgttaaccgtttgtaccggtttacgttaacccggggaccgtaaccggggtaccgaaacgggttaactaaacgttacgggaaaacccgttaaggttcgggttaaccncgggtttacctaaaccccgggtcctttacggtgtttaacccgg

SEQ ID NO: 146873 - DNA, 743 bp, Homo sapiens
  misc_feature: GYAE6OF02JWGVU.21.4.A04.1.454.CMB.1.raw
  modified_base (150)..(150): a, c, t, g, unknown or other
  misc_feature (150)..(150): n is a, c, g, or t
  modified_base (420)..(420): a, c, t, g, unknown or other
  misc_feature (420)..(420): n is a, c, g, or t
  modified_base (692)..(692): a, c, t, g, unknown or other
  misc_feature (692)..(692): n is a, c, g, or t
tcagtcgtcgctcgcacgaccggtgctcgatttagagtagtgatcagggagctcgtgagagcggagccccagccccagaacttccaggtgttttcattggtgatcagcactgaacacagacggacctcaccatcgggagtttgggctagngtcgttgggttttccttggttgttattttacgtaaggtgttccgtagtgtggacggtgcgagcgtggtcggagtcgtgggggactacgttggtaccaggtcccgtagggacgggttacccctggacgtaccttcgtccttgtcgactacggtcctactcgactacgttccacttcgagtacgtaccaacaacgtagtcggactcgggtaccacgacggcctaccgggagggacggtgcggaggtcggtcggacgtagtaacgaacggtanacgttaacgagttaacacgacacggaagtccggcgtaccggtgtaacggtaggtaaacggacggttacgacccttaagttacaacggtaaaggtacgtagttaacgtaacgttaaaccgaaggttaaacctcgtaacgttagttaacgctaacgggtactaaaacggacttaacggacctaaccggaaaccggttaaacgccggtaaacgttaacggtaccgtaattaccgggttaattaccggggtaacgttaaaggaaacttaaacgggngggttaacgtacgggttacggttaaggttaggcggtttacctaggttacgg

SEQ ID NO: 146874 - DNA, 699 bp, Homo sapiens
  misc_feature: GYAE6OF02F5TVU.21.4.A04.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagtcgtcgctcgcacgaccggtgctcgatttagagtagtgatcaggggagagctgctcagttaggacccagagggaaccaatggaaaccccagcgcagcttctcttcctcctgctactctggctccaggctcagaaaccacgganaattgtgtgacgcagtcctccaggccaccctgtctttgctcgagggaaancgccacctctccngcagcctccagaccaagtaacttacnccagacgtactaactagaacttcgcctcggtaccagaccaagtaacgccgtggcccgacgggtcctccccgtacggtttccctactaacttcgttgtacgtccggttacggtccccgtaacggccgggaccctacgttcggacctaccggtacccaacggtaaccgttacggtttacgaacggtcgggtacggtaggtttacgggttcggtaacgggtaactacgggtaccttacgaccttacgctactacgtaagttacgtacgacgtaacggtgacgtccgtagtaagttcgttacggtacgtagttagttacgttacgttacgtcgtagtactaggtacgttaagacgtttctcgtattccggttacgtaccggtacgaacggtacgtaaaggtaacgttaagtaacggtaaccttaggtcggtaacgtcgtaaccgtaccgaacttcggttattcccgg

SEQ ID NO: 146875 - DNA, 797 bp, Homo sapiens
  misc_feature: GYAE6OF02IKWBU.21.4.A04.1.454.CMB.1.raw
  modified_base (129)..(129): a, c, t, g, unknown or other
  misc_feature (129)..(129): n is a, c, g, or t
tcagtcgtcgctcgcacgaccggtgctcgatttagagtagtgatcagggggagagctgctcagttaggacccagagggaccatcggaaaccccagcgcagcttctccttcctcctgctactctgctccnggctcaagaaaccacggaagaaagttgtgttgacgctagtcctccgaggcctacccgtgttctttcgtctaccggaaggggaaagaccgtaccctaccctcttccgtgaccacggcctaccgacggtccaagtaaactactacccaagaccgtacctaacgtacaacgttacgaccgttcggtaaccacggtaaccgaacggaaccgccccggtacggacccgaacgggtccccttaccccgtaaggtttccccactaactttaccgttacggtcggcccggttacccggtaccccgaccggaccggggtccctaacggtcggtacccaacggttacccgaaggtaaccggtaggttacgagggtcgtacggtgggtttacgggcggtaacggacgtacgtaccgttactacctacgtactaacctacgtacgttaacgacgtaacggtacgtacggtaccgtacgtaacgttattacgtttcgacgttaagttgttaacgtttactcgtaaccgtagtaccgttaaggtaaccgtaggtaccttaccgtaaccttaggttccgttaccggtccgaacggtaaccgtaacggaaggtaaacgtaacgaacggtaaccgtacggttacggacgtaccggtaccgttaccgtaacgttcgttaccgtacg

SEQ ID NO: 146876 - DNA, 646 bp, Homo sapiens
  misc_feature: GYAE6OF02G8TPZ.21.4.A04.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctccgagggaaagagcctaccctctctgcagctccagccaagaactactccgaagagactaactacatagcctggtaccagcaaggaacgcctggccctagcctccgagtttccngatctagtcgcgtacggtccagcgggtccacgtcggcactcccgaagtcgaggtttacagggttcgcgtaagggtcggtactagggacacgtacttacgacttcgactacgtctaagtgacctaacgtactacgggtacaccgtagtaaacgttacgttcgaactagttattaacgttaacgttcgtacgttaacgcgttaagtaaggtacgttaacgttaccgaaccgtttcgtacgttccggttacggaaccggtaacggtaaccgttaaggtaaacgttaaacggtaacgtaaaacgtacgtacggtacgtacgaccgtactaacccgtagttccgttaacg

SEQ ID NO: 146877 - DNA, 656 bp, Homo sapiens
  misc_feature: GYAE6OF02GSVI2.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccaggagggaaccatggaaaccccagcgcagcttctcttcctcctgctactctggctcccaggctcaagaaaccaccggaagaaattgtgttgacgcagtctccaggcacctgtctttgtctcgaagggaancgccaccctctcctgcacgtcctccagaccaagtaactactccaagagacctaactaacagtagcccttacggtaccagcaagaacgtccgtaggccaggcctcccgtaggttaccctctatcgtatcgaccggtccggtccacgtacggcctagcgcctactccgaagacgtacggttcacggtcgcgaggtgggtctaggactacgtacttcgacttcgatcgtactacgtagtcgagtcgtacgacggtcgtagtaacgtcgtttacgacgttgttacgttaacgttcgtacgtaccgtatacggtagttaagttacgggttaacgtaccgtacgttccgttacgggttaaccgtccggggtaaccgtagggtaacgtaacgggtaaacgaacggttaaacgaacgttaacgttacggtcggacgtaccgtacgtacctacggtcttaaccg

SEQ ID NO: 146878 - DNA, 792 bp, Homo sapiens
  misc_feature: GYAE6OF02GQD2Q.21.4.A04.1.454.CMB.1.raw
  modified_base (189)..(189): a, c, t, g, unknown or other
  misc_feature (189)..(189): n is a, c, g, or t
  modified_base (355)..(355): a, c, t, g, unknown or other
  misc_feature (355)..(355): n is a, c, g, or t
  modified_base (610)..(610): a, c, t, g, unknown or other
  misc_feature (610)..(610): n is a, c, g, or t
tcagtcgtcgctcgcacgaccggtgctcgatttagagtagtgatcaggggagctctgagagcggagccccagccccagaattcccagggtgtttcatttggtgatcagcactgaacacagaggactcaccatcggtagttgggctgagctggtttcctgttgttatttacaggtgtccagtgtgaggtncagctggtggagtcgtgggggatacgttggtcccaggtcccgtggtacggggtccccttaggaggtaccttcgtccgttaggtcgactacggtcctcgtggcctaagtttccgaaccttcgaggttcgaaccccaacaacctagtacggaccgttggggtaccccncccgaggtaccgtacccggaagggggtaaccgggtcttacgggacgggttcggggtcccggaccggttaagttaaccgaaagggaaacggtcttaaaccgagttaaccgagtaaccaagtaaacctcgggcgtacctgtacgtaaggtaaggaacgttccaacgtacgtctacgaaacggagtagtacgtaattacaaaacggttaccacgtaacgtcgtacttaaccgtagaacctaaacggtcgtaaaacccnggtaaccgaacgggtaaaacccgaggtaaacccgtacccgggggtaaccttacgggttaacgttaacggttttacggtaaacgggtaacggttaaaaccctaaacgggggttaacgttccgggttaaagttcggggttaaacccggttagggtaaccggttcccggtaagggtttaacccgg

SEQ ID NO: 146879 - DNA, 846 bp, Homo sapiens
  misc_feature: GYAE6OF02FZ6RN.21.4.A04.1.454.CMB.1.raw
tcagtcgtcgctcgcacgaccggtgctcgatttagagtagtgatcagggggagagctgctcagttaggacccagagggaaccatggaaaccccagcgcagcttctcttcctcctgctactcgtggctcccaggctcgacgaaaccaccggagaaattgtgttgacgcagtctccaggcaccctgtctttgtctccgaggggaaagcgcccacctcgtcctgcagcctccagccagaactactccagagctaactacatacgccttggtaacccagcaacgaacgccgttacggcccgtagggccttaccccgtacggttccctcgattccgtagtcggtccgttcggggtaccccaacggtaccggggtccctaacggtcgggtacctaaccgtttacccccgaaggtaaaccccggtagggtttaccgaacggggttcgggaccgtaacgggggttttcgggtccggttaacgggggaaccctaaggttaacccccgttttcgtaacccgtttacctaccgttaacgtttaccgtaaaaggttttccgaaccgtaacgggtttaaccgtacggggtaaccgtccgttaaaggggtaaacgtttccgttttaaccggaccgtttagggtttaacgttaaacgttttcccggtagttacgtacggtacgttaaggttaacggttacgttaacgttacccgttacgtttccggttacgttccgggtttacccgaacggttaacgggaacggtaaagggttaaacgtaaaccggttaaggtaaaacccggtacggtttaacggtcggttaaccgttacggtaactacccgttaacggttccgtttaccg

SEQ ID NO: 146880 - DNA, 769 bp, Homo sapiens
  misc_feature: GYAE6OF02FE9KX.21.4.A04.1.454.CMB.1.raw
  modified_base (189)..(189): a, c, t, g, unknown or other
  misc_feature (189)..(189): n is a, c, g, or t
  modified_base (688)..(688): a, c, t, g, unknown or other
  misc_feature (688)..(688): n is a, c, g, or t
  modified_base (749)..(749): a, c, t, g, unknown or other
  misc_feature (749)..(749): n is a, c, g, or t
  modified_base (755)..(755): a, c, t, g, unknown or other
  misc_feature (755)..(755): n is a, c, g, or t
tcagtcgtcgctcgcacgaccggtgctcgatttagagtagtgatcaggggagctctgagagcggagcccccagcccccagaattcccaggtgttttcatttggtgatcagcactgaacacagaggacctcacccatgggagtttgggctgagtcgtgggtttttccttgttgtttaatttactaaggtntccagtgtgaggtgcagtcgtggtggagtcggtagggggatacgttcggtcccagccgttaggggtaccgggttcccctaggacgtaccttcgttacccgttggtcgacgacgtccctcgtcgccttacgttccctacccttacgtacggttaccgaaacccaaccgtaaccgtagttacgggtaaccggtttcgggccccgtaccgacggtacccgtaccggaaggggggtaacggggcgttaggggtacgggtcggggtaccgtaccgttattaaacggaaggtaaacgtaccgtaagtaaccgtttacgaacgttaacgaaggtaaacgtccggcggtacgttcgtaggaacgaaaggggttaccgttccaactactacgtacgaaagtcgtaagttacgtaacttaacccgaaaagtacctcgttaaaccgttgttacctacggtaacgtaaactaaactaggaaccctaacgtaccgtaaacgtaaaccggacnccgggtaacgttacgtgtttatcgaggttaacgaaccaaaacgtaggtgtaggtattgggnggttancggtacgtgtaccg

SEQ ID NO: 146881 - DNA, 628 bp, Homo sapiens
  misc_feature: GYAE6OF02JXQ09.21.4.A04.1.454.CMB.1.raw
  modified_base (198)..(198): a, c, t, g, unknown or other
  misc_feature (198)..(198): n is a, c, g, or t
  modified_base (395)..(395): a, c, t, g, unknown or other
  misc_feature (395)..(395): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccagcaccctgtctttgctccaggggaaanagccacctctcctgcagctccacgccagtactactccgagacgctaacacagtacaccttggtaccagcaagaacgcctggaccaggtcctcccgacggttcctcatctatcgtcgtacggtacccacgtacggggccctaacgtggacctacggtccctaacgaccgtaggttcacggttaggcctaggtgggtcngggacctagacctttcacctcgtacactactagttacgacgtacgacgtcggagccttagaacgtatttacggactaggttattacgtttacgtcgtaccgtaagtctaaggtagtacgggtaagtttcccgaacttcgtacgttcggtcgtaacccgagggacctaagggtacgaaataacggtaacgtaacgtgttacggacgttaccggacctacgtacttaccttacgg

SEQ ID NO: 146882 - DNA, 674 bp, Homo sapiens
  misc_feature: GYAE6OF02JT0I4.21.4.A04.1.454.CMB.1.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (425)..(425): a, c, t, g, unknown or other
  misc_feature (425)..(425): n is a, c, g, or t
  modified_base (490)..(490): a, c, t, g, unknown or other
  misc_feature (490)..(490): n is a, c, g, or t
  modified_base (669)..(669): a, c, t, g, unknown or other
  misc_feature (669)..(669): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagttgggctgagcttgggttttccttgttgttattttacgaggtgtccagtgtgaggtgcagcgtggtggagtcgtgggggatacgttggtcagtccgtggacggtccctgacgtctctccgtgctcgcgcctctcgactacttccaccgttnaggtcaacccgataacngtacggacgtccgggtccgacccgtaggtccctaccggaaggggtacggggctacggggagggtggggtaccggccggttaagtaacgaaagggaactcgtaaactcggttaacacgtaanaacggtaagtccgggctacgtcgtagaacgggtaagtacggtaccaacgtaccgtactaggaaanacggttagtaactagttaaacaaggtaaccttacgagttacgttaacgtatacggtaacaaacggtacgaacaggtaacccctaggaaaccgaggtacctaaccgggtacgtagttacgtttagtacggtgtaaacgaagtaacgaagttcgaggttggaaggttcgtaacgacggttntacgg

SEQ ID NO: 146883 - DNA, 616 bp, Homo sapiens
  misc_feature: GYAE6OF02H7ULB.21.4.A04.1.454.CMB.1.raw
  modified_base (148)..(148): a, c, t, g, unknown or other
  misc_feature (148)..(148): n is a, c, g, or t
  modified_base (156)..(156): a, c, t, g, unknown or other
  misc_feature (156)..(156): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgganaaattgtnttgacgcagtctccaggcaccctgtctttgtctccgaggggaaangccacctcncctgcagctccagccagatatcaganctanacatnctggtacagcagagcctggccaggctaccagttcccanattcctatcgccgtggtacccagtcggacctagtggccaagtcccagtacgtggtcaggtcgcaggtggtcaggacctgtacttcgatcactatctagttacgacgacgacgtggacgtccgtacggtaatacgtttacgaccgtagttacgttattaccgtagtaccaggtaccgtaagttagtacgtaacgttactaccgttcgtacggttacggtttacggaacccgtaacgggtacccgtaaagggtaacgtaaaccggttacggtaaaacggtaccgttacgggtacggtacctacggtacccgaaccgttaccgttacgttacccgg

SEQ ID NO: 146884 - DNA, 754 bp, Homo sapiens
  misc_feature: GYAE6OF02ICAI3.21.4.A04.1.454.CMB.1.raw
  modified_base (199)..(199): a, c, t, g, unknown or other
  misc_feature (199)..(199): n is a, c, g, or t
  modified_base (587)..(587): a, c, t, g, unknown or other
  misc_feature (587)..(587): n is a, c, g, or t
tcagtcgtcgctcgcacgaccggtgctcgatttagagtagtgatcaggggagctctgagagcggagccccagccccagaattcccaggtgttttcatttgggtgatcagcactgaacacgagaggactcacatggagtttggctgagtcttgggttttccttgttgttattttacgaaggttcgtccagtgtagaggtncagctgggtggagtcgtgggggatacgttggccagtccgtgggtacgggtccctaggacgtacttccgtcctggtcgtccacggccttcgtgtacctatttccgacctttcgaaggtaccgacctaacaaactggtacgggtaaccgttggggtccccgcggaacggtcctacccgggaagggggaacggggtcgtaggggacgggttcggggtacccggtcggtaattaacgaaaagggactacgtaaacgtaggtaacaagtacgaaggtactacggcggtactcgtaggtaacggtaaacggtacggtttccaactacgtacgtaacgaaagtacggaacttagtaactaacgaaaaggtaacctacgtatacggttactacgtnaacgtaaacttaaggaactaacggtaacctaaaccggaaaaccgcggaaaccgtccggtaacgttagtaacgtttaacggttcgggttaaaggtaactaaaacggtaaacgggtaggtaggttaacgttggtaacggggttacgggtacctacggtaccggtaaacg

SEQ ID NO: 146885 - DNA, 749 bp, Homo sapiens
  misc_feature: GYAE6OF02GSNH5.21.4.A04.1.454.CMB.1.raw
tcagtcgtcgctcgcacgaccggtgctcgatttagagtagtgatcaggggagagctgctcagttaggacccagagggaaccataggaaaccccagcgcagcttctcttcctcctgctactctggctcccaggctcagaaaccgaccggagaaattgtgttgacgcagttcctccgaggccacccttgttctttgtcctccgaaggggaaacgcgcccacccgtctcctgcacgcctaccgacgaccaagaactactaccgaaggacgtacctaaccgtaacacttacgtacccgttacggtaaccacggaccgaaggaaccgtcccgtacgggaccccgtaacgggtcccctaccccggttaacggtttcccctacgtacgttcttacgttccggccggttccgggtaccccacggacgggtccctacgtcggacctacgtcccgaagtaccgtaggttcgaggtcggtcgtagggttcgggtacgtacgggaaccgtacgttacccttacgaccttcctacgtatactacgttacgacgtacgacgtcggacgtcgtaaggtaactacgtttcgacgttagttacgttacttacgttagtaccagtacgtagttacggtagttaaccgttaccgttaccgttcgtcggttacccggtacgtaaccggtaacgggaccgtaaagggtaacgtaacgtaacgtaacggttacgtcggtacgacgtacccggactaccgttagtcgttacg

SEQ ID NO: 146886 - DNA, 791 bp, Homo sapiens
  misc_feature: GYAE6OF02IDLAD.21.4.A04.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
tcagtcgtcgctcgcacgaccggtgctcgatttagagtagtgatcagggggagagctgctcagttaggacccagagggaaccatggaaccccagcgcagcttctcttcctcctgctactctggctcccaggctcagaaaccaccggagaaattgtgttgacgcagtctccaggcacctgtctttgtctccgaaggggaanacgcccacccgtntcctgcacgctccagccagatactccaagngtcctactacgatacgccgtcgtaccgagacgtagaacgccgttcggcccgaacggtcctcccgtaacggtttcccactacgtctaacgtgaccgtccggtcccaacgtaccgggtccacgtcggacctacctacccggaagtaccgtagggtttccgngggtaccgggtcggtacggttacgggtaccggttaggggactaacggtccttaaccgactccgtacgtattaccgtagttacgtccggaaggtaccgtcgggtaacgaccggttacgggttaaacgttcgtttacgggtaacccttagggtttaccgttaaacgtttaccggtacggtaccggtacgtaccgttaaggttacggttaacgggttaaaccggttcccttaacccgggtttccggttaccggttccgggtttaacccgggtaaccggtaacggggtaaccgttaaacggggttaacgttaaagtaccggggtaaaaccgttaacccggttacggtacggtcccggtaaggtacccgtaccggtttaaccttcgggttaccc

SEQ ID NO: 146887 - DNA, 747 bp, Homo sapiens
  misc_feature: GYAE6OF02JU7A3.21.4.A04.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcgagaaaccaccggagaaattgtgttgacgcagtctccaggccaccctgtcttgtctaccgagggaanacgtccacctctcctgcacgcnccagcccagtaactacgtccaagacgcctaactacgattacggccttcgggtaaacccagaccgaacggaaacggtcccctagggacccgtacggcccttaccccgtaacggtttccctacgtaacttcctaacgttcgtaccggttccggtaccccaacggtaccggggtacccacgtcgggactaacccgtcccgaaacggaccgttacggtcccgtaaggtacggccgtaaggggtttcgggtccgtacggggtaactacggttaccttaccgtacgtaccgtctaacgtacgtaagtacgtacgtaaccgtacgtacggtacgtccctaaggtaacgttaccgtttcgaccgttaacgtcgtttaacgtacgttcgtacgtaacgcgtaagttacgtaccggtaacgtcctaacgttcgtacggttacggtccgaacggtacggtaacgtaggtaaaccgtaaagtacggtaaaccgtggtacgtacggtcgtaccgtcgtaaccgttgttacgttacg

SEQ ID NO: 146888 - DNA, 681 bp, Homo sapiens
  misc_feature: GYAE6OF02H1M11.21.4.A04.1.454.CMB.1.raw
  modified_base (119)..(119): a, c, t, g, unknown or other
  misc_feature (119)..(119): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (467)..(467): a, c, t, g, unknown or other
  misc_feature (467)..(467): n is a, c, g, or t
  modified_base (563)..(563): a, c, t, g, unknown or other
  misc_feature (563)..(563): n is a, c, g, or t
  modified_base (574)..(574): a, c, t, g, unknown or other
  misc_feature (574)..(574): n is a, c, g, or t
tcagtcgtcgctcgcacgaccggtgctcgatttagagtagtgatcaggggagctctgagagcggagccccagccccagaattcccaggtgttttcatttggtgatcagcactgaaccanagaggactcaccagtgggagtttgggctgagcgttgggttttccttgttgttatttacgaaggtgtccagtgtaggaggtgcagtcgtgggtgggagtcggtaggggggatacgtttggaccaggccgtagggacgggttccctagacgctccgtcctggtcncgacggtcccttntacgtccttaacttcctaccttagacgtacgaacccaactaaaacctgttcgggaccttcggggaccccaccgacggtccgtaccggaagggggaacggggtcgtgggagggtcggggtaccggtaccgttaagtaacggaaaggtaaactcgtaaacgtgtaacacggtanaaacgtagtccggcgtccgtactaggtaacgggaagtaacgtacacctagtacctaagagtaacgatacgataacaaaggtaccatacgtatactntacgataaagnaacgacgtaacgaacgaaacgacggaacgtaacgtacgtagtattagtggtacgaagaacgaaaggtagtaggtagtacgggtaggtacggtagttccgagttacgg

SEQ ID NO: 146889 - DNA, 805 bp, Homo sapiens
  misc_feature: GYAE6OF02J1KP7.21.4.A04.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaaattgtagttgacgcagtctccaggccaccctgtctttgtctccgaggggaanactccacctctcctgcagctaccacgccagaactactccagtacgtctaacctacagttacgccttacgggtaaacccaggtacaacggtaaaccgtccgtaggaccccaagggtccctacccccggtacggtttaccctacaattccgttaacgttcgaccggttccggggtacccccaacgggaaccggggtcccctaaacggttcgggaccctaaccgttacccaagggtaaaccgtacggttacgtaaaccggttggggaccgttaaggggttccggggtacgtacgggggtaaacctaacggggtaacctttttacccgaaccgtttacccgttacgttaactaaccgtttaagtaaccgtcgtaaacggtaccgttacgggaaccgttaaccgtagggtaacgttaacctttcggaacgttaagtttacggttaactttacgtacggttacgtaacggtacgtacgttaagtacgggtacttaaccgtaccttacgtcggtccgttaccgtaccggtaaggaacgtaacggtaacggtaaactaacggtaaacgtacggtacggtacggacgtacgaccgtacttacgtccgttaacg

SEQ ID NO: 146890 - DNA, 886 bp, Homo sapiens
  misc_feature: GYAE6OF02HI64O.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtcctccgaggcctaccctgttctttgtcctccgaggggaaagcgccctaccctctcctgccagctccgacgccagaatactaccagacgccttaactacagtacgcctaggtaaccagacaacggaaacgtcccgtacgggacccgtacggtcccgtaccccgtacgggttttccccacgtaacgttcgttaacgttcgggtaccccggttaccggggtacccccgaccgggtaaccggggtaccccttacggtaccggggacctacccgttaaccccgaaggtaaccgttacggtttaccggaaggtccgggacgttaaggggttcgggttaccggtaacggggaacctaaccggttacctttaccgtaacccgtaccgtttaccgtaacgttaccgttaacggtttaacggaccgttaacggtaacccggtttacgggacggttacccgttaacggggtaaaccgtttcgtttaaccgggaccgtttacggtttaacgtttaaaccgtttacggttaccgttaccgtacggtaacctaacgggtttaggtttaaccggttaccgtttaccgttaccgttccggtttaccggttaaccgggtttacccgaaccggtaaccgggaaccggttaaagggtaacggttaaaccttaaacgggtaaacgtacggttacggttacggaaccgttccgaacccgttaccgtagttttaccgtaccg

SEQ ID NO: 146891 - DNA, 696 bp, Homo sapiens
  misc_feature: GYAE6OF02H0330.21.4.A04.1.454.CMB.1.raw
  modified_base (317)..(317): a, c, t, g, unknown or other
  misc_feature (317)..(317): n is a, c, g, or t
  modified_base (538)..(538): a, c, t, g, unknown or other
  misc_feature (538)..(538): n is a, c, g, or t
tcagtcgtcgctcgcacgaccggtgctcgatttagagtagtgatcaggggagagctgctcagttaggacccagaggaaccatcggaaacccagcgcagcttctccttcctcctgctactcgtcggcctcccgagctacaacgaaaccgaccggtaataaattgtggttcgacgcagtctccgagcctcctgttcctttgtcctaccggaaggggaagacgcccacccttcgtccgtgcacgcctccacgaccagaatacacgaacgcgacctactacgatacgccgttacggaccgagacaagaacgcgtcggaccncggtcctacccgtacgtcctcacgttctacgtcgcgtcgccgacgcggaccacgtgaccactccgagacgtacgtcgacggtcgtcgagggttcgggtacgtacggacgtaacgtaccctgtaacctcgttaccgtatacgtagtacgaacgtacgtaacgcgggtaacgtacgttaacgtacgtttaccgttacgtacgtgttaacgttactttacgtanacgtagactaaggttacgtacggttaacttcccgtaccgtttcgggttacgtccggttaaaccggtccggtaacgggaacgttaaacggtaaggttaaaccgaagaacccggttacgttaggtacgccgttacaaccctacggttacttcgttaaccg

SEQ ID NO: 146892 - DNA, 897 bp, Homo sapiens
  misc_feature: GYAE6OF02I16QV.21.4.A04.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggccagaaaccaaccgacggaatacgttgtagtacgacagtcgtcctacggaccgtacctcgttcttttacgtcgtaccgtaacggggaaaggtacncccgtaccccttaccgtccttccgcgaccgtaccgttccaacgacctacgtaactacttaccaccgagtcctaactaccaagtaacgtcctacggtaacctacgaccgttaacggaaacggtccccgtacggtccgtaacccgggtccgttaccccggttaacccggtttcctttaacccgtactttacccgtttaagtcccggggttaccggttacccggggttaccggtaaccccggtacggggtaccccgtaaccgtaccggttacccggtaacccttaaccccggtaaccggaaccggttttaaccggggacgtttacgaccggtacggtaccgggggtttaccgggtggtttaccggggaactaaccggttccttaaccggtaccccgttattacccgtaattccgtaactacggttacgtaacggtaacggtacggttacggaccgtaagggttaaccgtacgtttaccgtacgttaaccgtttaaggttaccgtttacgttacgttcgtaacgttacgttacggtaagttacggtttaacggtacgttaccgttacgttcggtttaccggttacgggtaaccgtacgggtaccgtaacggtacggtaaacgtacggtaacgtaacgttacgtgtacgtacggacctcgtacgtacttgttaccg

SEQ ID NO: 146893 - DNA, 774 bp, Homo sapiens
  misc_feature: GYAE6OF02HMWPE.21.4.A04.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcacgaaaccaccggagaaattgtgttgacgcagtctccgaggccaccctgttctttgtctccggaaggggaancgcccacctctcctgcacgctccagccagaactactccgaagacgtcctaactacatacgccttacggtaccaggacctaacggaacgtccgtacgggaccccgtaacggggtccccttaccccggtaacgggttttcccctaaccgtaacgtttcccgttaaagtcccgggtacccggttaccggggtaccccaacgggtaccggggtaccctacggtcggacctaacctacccggagtaccgtacggttccgagggtcggacgtacggggtcggtacgacggggtactaacgtacttacgtaaccttgtactacgttacgtagtttaacgacgtacggtacgttacgggaaccttaccggagtaacgttacgttacggacgtttacgttacgtttacttacgtacgtacgtacgttacgtaggtttacggacgttactcctacgtttcgtacggttaccgggtaccgtaacggtacggtaacggtaaggttaaacgaacgttaacggaaacgttaaccgtcggttacggtaccgtaccgaccgtaacgtacgtttacccgttacg

SEQ ID NO: 146894 - DNA, 720 bp, Homo sapiens
  misc_feature: GYAE6OF02IA978.21.4.A04.1.454.CMB.1.raw
  modified_base (316)..(316): a, c, t, g, unknown or other
  misc_feature (316)..(316): n is a, c, g, or t
  modified_base (370)..(370): a, c, t, g, unknown or other
  misc_feature (370)..(370): n is a, c, g, or t
  modified_base (458)..(458): a, c, t, g, unknown or other
  misc_feature (458)..(458): n is a, c, g, or t
  modified_base (600)..(600): a, c, t, g, unknown or other
  misc_feature (600)..(600): n is a, c, g, or t
tcagtcgtcgctcgcacgaccggtgctcgatttagagtagtgatcaggggagctctgagagcggagccccagccccagaattcccaggtgttttcatttggtgatcagcaactgaacacagaggactcaccatggagtttggctgagcgttgggttttccttgtttgttattttacgaaggttgtcctagtgtgaggtgcaggcttgggtggagtcgtgggggatacgttggtcccagccgttgggacgggtcccttggacgtctccttccgtgtcgcacgtcccttgtacgcctaactttccaacccgtttacgnggtaccaacctaacctaaactacgttacggggtaaccgtttcgggggtaccccnccgtaacggtcgtacccgaagggggacgggtcttaggggagtcggggttccggaccgttaaattaaccggaaaggtaactacgttaanacggtttaacacgggttaacagtaaacgtcggctcggttactgggaaccgtaaagggtacggttcaaccgtagtacgtaacaaggtacgattagaacgttacgaaacgtaccgtactacgtagtaactctagaacaacgtanaacgagaccgtacgaaacgtacgaacgtacgtactgttacttacggtttacgtaggttaacgtaacgaaaaggtcgttaaggtagttcgggtacggttaggtaccggtagttagtaccgg

SEQ ID NO: 146895 - DNA, 746 bp, Homo sapiens
  misc_feature: GYAE6OF02F2IPM.21.4.A04.1.454.CMB.1.raw
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttatttacaagtgtccagtgtgaggtgcagctggtggagtcgtgggggagacgttgggtccaggccgtgggagggtcccctgacgactcctccgtgtcgcagcctctgcattccaccttcagtcgaccacaacatggacgtgggtccgcgaggctccgaggggacggggctgggtaggtcgggtcggcgttaagttacgaaggaaacgactaacgagttacgagtaacagaactacggcgcgtntgtaaggaaaggtaacggttcaaccgtataccgtaacgaaaggngtaacttagaaccgttaacgaaaaacgttacctaaccttaacgtttaggtaacttacccgttaaggtaaacctaaaagtaaccgggtaaacgtaaaccgtaccccggtttaaaacggaaaaaccccggggtaaaggtacccccgggtaaaccgggttacccggtttaggtttaaagttttaggttaacggggtttaagggaaaacggtaaaccggtaaaaagggtagggtttacgggaaggtttaccggggtttagggggttaacggtacgggtttacgttggttaaaccggg

SEQ ID NO: 146896 - DNA, 795 bp, Homo sapiens
  misc_feature: GYAE6OF02IFDUG.21.4.A04.1.454.CMB.1.raw
  modified_base (233)..(233): a, c, t, g, unknown or other
  misc_feature (233)..(233): n is a, c, g, or t
  modified_base (521)..(521): a, c, t, g, unknown or other
  misc_feature (521)..(521): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccgaccggagtaaattgtgttacgacgcagtcctccgaggtccaccccgtgttcctttcgtcctccgaaggggaaagcgccctaccctctccngcacgcctcacgaccgaagtaactactccgagacgaccttaactacgactaccgtccgttacggtaccgagtaccgaaggacgtcctcgggaccaccggccttcccgtacggtttacccacgtacttacgttcgtacggtccggtaccgggttacccccaaaggtcccggggaccctacgacgggtcctaacccgttaccggaacggtaacggtacggtttacggagggtacggacggtcgggttagggttaaccggtcggggaactaacggtccttaaccgcccttntaaccctaattacgtacgttaccgacgacggtacgttacgggtaacgtccgtaacggtaacgtttcggttacgtacgtttacgttaagtttaacgtaccgttgaacgtcgtaaccgtaaggtttacgtaacggttacctttaccgtcgttaacccggttcggttaccgttacgggaccggttaacgggtaaaccggtaagggtaaacgtaacggtaacgtaacccgggtaagttcgggtacgtacggtacccgtacgaacgttccgttacgtcg

SEQ ID NO: 146897 - DNA, 803 bp, Homo sapiens
  misc_feature: GYAE6OF02FXM1J.21.4.A04.1.454.CMB.1.raw
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaggggaaangccaccctctcctgcagcctccagccaagaattacnccgagacgctacctacagtacgccttaggaccagtcaagaacgccgtcgcctacggcttacccgaggttccctanacttctagtcggccgttaccgggtaccccacggacgggacccacgttcgggaccaccgttacccgacggtaccgtacggttacgacggttcggacggtagggttcggggttacggtcggggaaaccgtagaacccgttttaccgaccgttccgttaccgtaattaccgttaacggtttaccgtacgtaacggtacggtacgggtaccgtaccggttaacgggtaacgttacgtttaccggtaacgtaggtttacgtttaacgttaacgttacggtttaaccggaacggttaccggtaaggttacggtaccgggttaacggtttaccgtacgtttaccggtttcggttaacccgggttcggaaccgggttaaccggggtaaaccggtaagggttaaggtaaaccggtaaaccggtaaaccggttaaacgggttccggttacgggttaaccgttaccggtaaccgtacccggttaacgtttccggtttaaccc

SEQ ID NO: 146898 - DNA, 810 bp, Homo sapiens
  misc_feature: GYAE6OF02FL1NG.21.4.A04.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggactcccaggctcacgaaccaccggagaaattgtgttgacgcagtctccgaggccaccgtgttctttgtctaccgaggggtaaancgccaccttcnccgtnacagtcctcacgtccagaatcgacgagactactactacactacggtcctacggtaccgaatacgaggaacgcgttcggaccgtacggccccttacccggtagggttaccctacgtacgttacctagtacgtaccggttaccgggtacccgaccggacggaacccgtacggtcgaccgtaccgtaacccgagaaccggttcgttacgtacgggcgtacggttagggttacggtaccggtacgggaacctaaccgggttactttacccgggactttaaccgtcgtaaacgttactaaccggtttacggaaccggaagtttaacccggacggttacggaccgtttacggtaaagttccgtttaacggttcgtaacggtttacgtttaacggtttaccgtacggttaaccggtaaggtacgtttaacgtaccgggtaagttaacgttttacccgacgtttacgggttaccgtttcggggtaaccggtacccggtaacggggactttaaaccggggaaagttaacgtaaaccggaaaccgtcgggtttaggtaaccacgggttaccaaccggttacttactaccggttaccg

SEQ ID NO: 146899 - DNA, 844 bp, Homo sapiens
  misc_feature: GYAE6OF02I83S3.21.4.A04.1.454.CMB.1.raw
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
tcagtcgtcgctcgcacgaccggtgctcgatttagagtagtgatcagggggagagctgctcagttaggacccagagggaaccatcggaaaccccagcgcagcttctcttcctcctgctactctggcctcccaggctcaagaaaccacggagaaattgtgttacgacgcagtctccaggcctacccgtgtctttgtacctaccggaaggggaaancgccacctcgtcctgcganctcganacgagtaactactaccagacgtacctaaccgtaacgtacgttacgacccgttaggtaacccgaaggacctaaacggaccgacccgttacgggaccgtaaccgggcccttaaccccggttagggtttaccctactaaacgttccgtaacgtccgggtaacggttcccgggttaaaccccggacgggttaaacccgggtccccgttaacggtcccgggtaacctaaccggacccttaaaacggggttaccgtaaaccgggttacgaaacggggttttcggggaacgttaaccggggggtttacggtccggtaacgggggaaaacctaacggggttaaaccttcccgggtaaccttcctttaaccgaaaccctaacggtaaacctaaaccgacgtaccggtacgtaccgtaacgttcggtaaacgtttacggttacgacgttaaggttacgttacttacgttagtacgtaagtacgttagttacgtacggttacgtaccgtaccgtaccgttaccgtacggaaccggtacgaccggagtacggtaacgtaacggtaacgacgaacgtaaccgtaggtcgtacggtccgtacgtacctacgtacttacg

SEQ ID NO: 146900 - DNA, 769 bp, Homo sapiens
  misc_feature: GYAE6OF02HJ7AM.21.4.A04.1.454.CMB.1.raw
  modified_base (200)..(200): a, c, t, g, unknown or other
  misc_feature (200)..(200): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggcctcccaggctcagaaaccaccggagaaattgtgttgacgcagtctcaggcaccctgtctttgtctacgagggaaancgaccaccctctcctgcacgctccgacgaccaagaactactccagacgtacctaactaacaacgttacgaccgtacgggtaaccagaccaaagtaacgtccctacgggacccaagggtcccgttaccccgtaacgggttttaccctactacgtaccttaacgttcgtacccggttaccgggacccctaaccggtaccggggtacccaaggttccggacctaccttaccccggaagtaaccggtaggtttacccgacgggtaggaccgtaaggggtttcgggtacgttaggggaacctacgtaactttaccgtacgttaccttacgaacttactaacgtttacgacgtaacgtacgttaggggacgtaccgtaagttaaagttaccgtttagacccgttaagttcgtttaaacgttacgtacgtacgaacgtacgttagttaaggtaccgtaactttaccgtacttcgttacggtaccggttaccgaacgtaaccggtaacgtaaacgggtacgaaataccggtaaacgtacgtacggtacgtcgtacgtaaccgtactattccgtaacg

SEQ ID NO: 146901 - DNA, 819 bp, Homo sapiens
  misc_feature: GYAE6OF02F2MUL.21.4.A04.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaaccaccggagaaattgtgttgacgcagtctcaggcaccctgtctttgtctccgaggggaaangccaccctntcctgcagcctccagccagaatatccagagctaactacatacgcctggtaccagcaagaagcctaggccaggcctcccaggttcctcatctagtgccgtcgggtccccaacgacggggaccaacgttcgggacctaacgtaccccgtaaggaaaccgtacggtttaccgaaacgggtttcgggaccgttaaggggtttacgggggttccgttacggggggaaacctaacgggttaacccttttaaccgaaccgttttaccgttacgaacgtttacccgttaaagtttaaccggacgtaaacgggtaaccggttacgggtaacggtaccgttaagggtaaaacggttacgttttaccggaccgttaaaggttacggtttaaacgtttaaccgttaggtttaccgaaaggtaccgtaaaggtttaacggttaacggggttaaaccgttttaccgttaacccgtttccgtttacgggtttacccgggtttaccgggtaacccgtaaacggggtaaacccgtaaagggttaaaaccgtaaaggttaacggtaaaaccggtaacgttacgggttacggtaccgttacggaccgtaaccgttacgttcgttacgg

SEQ ID NO: 146902 - DNA, 781 bp, Homo sapiens
  misc_feature: GYAE6OF02JSH3T.21.4.A04.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagacttctcttcctcctgctactctcgctcccaggctcaagaaaccacggagaaattgtagttgacgcagtctccaggcaccctgtctttcgtctccgaaggggaaacgngaccccacctccttccgtcggccgacgtccttaccgacgaccgaaagtaactacgtaccgaagacgtacctaaacctacaacttaacggtcccgttacgggtaaaccccaggaccgaacggtaaaaccggttcccgtacggggaccccaggggtaccccttacccggtacgggtttacccttacgtcttaccgtaacgtgtcccggtccggggtaccccaagggaaccgggtccgtaccgtacgggccgtaaaccgttcccgaacgtaaccggtacggtccgtaaagggtccggacggtaacgggttacgggtcggttacggaacgtagacccttttcggaaaccctccgtagtaacctacgtaactacgtaccacggtaacgtcggtaacgacgtacgtaaacgggtacttacggtaacgtaacgtcgttaacgttacgtcgtaagacgtacgtaacgttacgacggtaacgttacgtaccgtcgtcggttacgtccggtaacgtaggaaccggtaagaacggtaactaacggtaactacgtacgtcggtacacggtacacgtgtacctacgg

SEQ ID NO: 146903 - DNA, 623 bp, Homo sapiens
  misc_feature: GYAE6OF02GURTT.21.4.A04.1.454.CMB.1.raw
  modified_base (144)..(144): a, c, t, g, unknown or other
  misc_feature (144)..(144): n is a, c, g, or t
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (527)..(527): a, c, t, g, unknown or other
  misc_feature (527)..(527): n is a, c, g, or t
tcagtcgtcgctcgcacgaccggtgctcgatttagagtagtgatcaggggagagctgctcagttaggacccagagggaaccagtggaaaccccagcggctagcttctcttcctcctgctactctggctcccagctcagaaaccncgganaaattgnttgacgcagtctccaggcacctgtctttgctccaggggaangcccacctctcctgctagctccagccagaattcnccagacgtctactagaatcgcctggtaccngtacagaagcctgggcccaggcctaccgtaaggtttcccncgtatcctgtcncgtccgggtcccagacgggccacgtggactacgttcccagtacgtacggtttccaggttcggacaggttcggactgggacacggtcttcactttcccgataccttctaaggttcaccgaagtcgttaacggcgaccgtagtaaacgtcgtttagccgtagttacgttagttaactcgttacgaaggtcctaagttacggtagtaacgtttaccncgttctttcggttccgtaccgaccggttaacggacgtacggtaaagtaaccttaaggaaacccgttcgtgtacgtacgtcaacgtctagtcttacg

SEQ ID NO: 146904 - DNA, 782 bp, Homo sapiens
  misc_feature: GYAE6OF02FFGYU.21.4.A04.1.454.CMB.1.raw
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (163)..(163): a, c, t, g, unknown or other
  misc_feature (163)..(163): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
tcagtcgtcgctcgcacgaccggtgctcgatttagagtagtgatcaggggagagctgctcagttaggacccagagggaaccatcggaaaccccagcgcagcttctcttcctctgctactctggctccagcctcagaaccacggagaattgtntgacncagtcncagctcctgtcttgctcgagggacncnccacctcgcctgcagccncacgccagtaactcacgagtctaccgtactanagtacggccttaggtaaccngtacgagaccgtccgcgggacctacggccttacccggtacggttccctagacttcgacgttccgtcggtaccggtaccacgggttaccgggaccacggttacggacctacgtaacccgaggtaccgtacgtttcggaccggtcgggtaccggtagggttacgggtaccgtagggaccctaacgggtttaccctcggacccttacgtctaaccgttacgtaactacgggtactaaccgggtagtaccggtacgtaccggttaacgaacggtttccgtaacggtcgtaacggtttcgttaccgttaacggtccgtaacggtaaccgtgtaaacgggttaaggtaccgtaaacggtttcccttacggggtaccgttacgggttacccggttaccgggaaacccgtacggtaaacccggtaggggtttaaaacccttaaggaaacccccgtaaaggtttcccgggggacttaccccggttagggaacccttaccccggttaacccttacgggttaccccttaaccc

SEQ ID NO: 146905 - DNA, 803 bp, Homo sapiens
  misc_feature: GYAE6OF02FLK4M.21.4.A04.1.454.CMB.1.raw
  modified_base (52)..(52): a, c, t, g, unknown or other
  misc_feature (52)..(52): n is a, c, g, or t
  modified_base (105)..(105): a, c, t, g, unknown or other
  misc_feature (105)..(105): n is a, c, g, or t
  modified_base (122)..(122): a, c, t, g, unknown or other
  misc_feature (122)..(122): n is a, c, g, or t
  modified_base (149)..(149): a, c, t, g, unknown or other
  misc_feature (149)..(149): n is a, c, g, or t
  modified_base (206)..(206): a, c, t, g, unknown or other
  misc_feature (206)..(206): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
tcagtcgtcgctcgcacgaccggtgctcgatttagagtagtgatcagggganagctgctcagttaggaccccagagggaaccatggaaaccccagcgcagcttcncttcctcctgctactcnggctcccaggctcagaaaccaccgganaaattgtgttgacgcagtctccaggcctaccctgtctttgcctaccgaggggaaacncgcccaccctctccgtgaccaggtcctccgagtcccaagtaactactccgaagtacgtctaacctactanacgtccctaggtaacccngtaccaaggtaacgcccgttggaccaccgggtccttcccccgtaagggtttcccctacgaacttccgtaagtcgtaacgttcccggtacccaaggtacggaccctaacggtggaccctacgtacccgaggaaaccggttgttacccggaaggttcggactacggggtcggggttactaggggaaacctaacggttaccttacccgtacgttaccctacgtacgtaccgttaacgtaccggacgtacggtaaccgttaggtaccgaccgtacggtaacgtacggttcgtaacgtacgttacgttaacttaccggtaggtacccgtaacgtaccgtaacggttacgttacggttaaccgttaacccgtaccgttccggttaaccggttaccgggtttacccgacgggtaaccgggtacggttaacggttaaacggtaacgtaaccggtaaacgttaaccggttaggttaccggacgttaccggaccgtaaccgttacgttaccggttacgg

SEQ ID NO: 146906 - DNA, 655 bp, Homo sapiens
  misc_feature: GYAE6OF02GQ86U.21.4.A04.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttgggtccaggcccgtgggacgggtccctggagactctcctgtgcagcctctgcattccaccttcagtgaaccacaacatggactcgggtccnccaggctccgagggagggctgggagtgggtcggccgtattacgaaaggaacgctaaacgagttaacagtaacagaacgtacggcgcggtctagtaggaaaaggtacggttccaacctagtcctacgaaagagaagtgaattaccgaaaaggtaacctacaacttaggtactacgtagactaaagttcgaaacctacggaaccttaaggaaaaacccggtgggaaacccgaacggggtccgttaagttaacgtttaagttacgggttaacgggtaataaaccgtaaaaaggtaggttaaggtaacgttaggggttaggtcgggtaacggtcgtaggttaaccgg

SEQ ID NO: 146907 - DNA, 684 bp, Homo sapiens
  misc_feature: GYAE6OF02GE5PQ.21.4.A04.1.454.CMB.1.raw
  modified_base (198)..(198): a, c, t, g, unknown or other
  misc_feature (198)..(198): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgctcgaggggaancgcccacctctcctgcagcctccagcctagaactactccaagngcctactacgatagcctggtaccagacagaacgcctggccaggcctccgacggttccctnacttctatcgcgtcgggtcccaacgacggggccacgtcggctactcccgaagtacacggttcaggtcgccgtaggtcggtcgtaggactagtccttacgacttcgtcacgtcagttacgacgacgtacgtgggtacgcgttaacgacgttacgtttccgaacgttacgtttacggttaactttacccggtagttacccgaagggtaccttagggtaaccggtttacggtaaaccgtttcccgtaaccgtttccgttccgggttacgtttccccggggaaacgtacgggtaaaccgggtacggttaaaaggaaacccgttaacgggaacgttaaccggtcgggttaacgaccggtaccgacccgttactacggttccttaccgg

SEQ ID NO: 146908 - DNA, 790 bp, Homo sapiens
  misc_feature: GYAE6OF02HHQHX.21.4.A04.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagtcgtcgctcgcacgaccggtgctcgatttagagtagtgatcagggggagctctgagagcggagccccagccccagaattcccaggtgttttcatttggtgatcagcactgaacacagaggactcaaccatggagtttggctgagtcttgggttttccttgttgtttaattttacgaaggtcgtcctagtgtagaggtgcagctgggtgagtcgnggggancgttggccagccgtggacggtcctgacgctactccgtgtcgcacgtcctgtanctacttccaccttcgagttaccgaacctaaacaacgtacgtacgggtaaccggtcggggtaccccaaccggttcgggacctaacggggagggggtaacgggccgtagggtggtacgggttccgaaccgttataaacggaaacggaacgtacctaaagtacggttaacaacggtaaccgtaagaaccggttcggaccgttaccggtacggttagggtaacggtaaaagggttaaccgtacgacgttaaacgttaccgtaacgaaagttaacgaaggtaagttaaaccctaaaggaaaaaccgtacgttaacgaaccgttacgtaacttcggaaccgtaaataaaaccggtactaaacggaccgttaaaccggaaacggtaaaacccggacgggtaaacccgtaaccgggtacgtttaagtagtttaacggtacggtaaacgggtaaacaaacggtaaaacggtgggaagttgggttaagggtccggtaaggtaaccggttgtaacggttaacgg

SEQ ID NO: 146909 - DNA, 733 bp, Homo sapiens
  misc_feature: GYAE6OF02GSB8W.21.4.A04.1.454.CMB.1.raw
  modified_base (151)..(151): a, c, t, g, unknown or other
  misc_feature (151)..(151): n is a, c, g, or t
tcagtcgtcgctcgcacgaccggtgctcgatttagagtagtgatcaggggagctctgagagcggagccccagccccagaattcccaggttgttttcatttggtgatcagcactgaacacgagaggactcaccagtggtagtttgggctagngtcgttgggttttccttgttagtttatttacaaggtgtcgagtggtggtaggtgcgtagtcgtggtaggtaggttcggagggggtagtaccgttcggtacccaaccggttggtacgggttccctaggacggtaccttccgtccgttggtagccgtacgtccctgcgtactacgttcctaccttacgtacgtactaacccaactactacgtcggtaccggtccggtacccgccgtacggtccgtaccgggaaggggtaacgggtcggtgggtacggtcgggtccggtacgttaagaacggtaaacggaactacgtaaacgtagtaacgtagacgaagtaaacgtcgaaccgtcgtacgtaggtaaggtaacggtacgtaaccgaacgtcgtacgtaacgagtagtaagttcgtaaacgtaaagtaaacgtacgtaacacgttacgtactacgtacgaacgtaatacggaagtaccgtaacggtaaacgaaccggaagccaaggttaccgtagttacgttagtaggtacgtaaaggaacgtaaggtaggtgtaggtggttggtaagtgtaacggtgaacgtacg

SEQ ID NO: 146910 - DNA, 885 bp, Homo sapiens
  misc_feature: GYAE6OF02H2TMW.21.4.A04.1.454.CMB.1.raw
  modified_base (163)..(163): a, c, t, g, unknown or other
  misc_feature (163)..(163): n is a, c, g, or t
  modified_base (207)..(207): a, c, t, g, unknown or other
  misc_feature (207)..(207): n is a, c, g, or t
tcagtcgtcgctcgcacgaccggtgctcgatttagagtagtgatcaggggagagctgctcagttaggacccagagggaaccatggaaaccccagcgcagcttctcttcctctgctactctggctcccaggctcagaaaccgaccggagaaattgtagtgacgnacgtctcccaggccacccgtgttctttgtctaccgaaggggaancgcctacccttcgtcctgacgactccgtaccaggacccagtaaactacgtaccgaggtaccgtacttaaccggttaacacgttaaggtacccgttacgggtaaccctaaggacgaaggtaaccgacccggttacgggaccccgtaaggggtaccccctaaccggtttaccggggtttacccctaacgtttacggtaaaccgtttacgtaacggttcccggtttacccggggaaccccacgggttaaccgggggaaccccttaacggagggtaaccgtaacccttaaccccccggaaaggtaaccgtttcggggtttaaccctacgggggttacggaacggtaaccgggggttttcggaacggtttacggggaaccgttaacggttaactttaccggactttaacctcggtaaacgtaccggttaacgttaacgtaacgtaacggtaaacccggtaggtaacggacccgtaagtaaacggttacgtttaacacgttacggttacgttacgtttacgactacgacgtacgtagtagtacggtaacgttaccgtacgttcttacggttacggttacggtaccgtaaacgggtaccgtaaggtaaacggtaaacggtaaggtaaaaccggtacgttacgggtacgtacggtacggtaccctaacgttagttaccgttaaccg

SEQ ID NO: 146911 - DNA, 795 bp, Homo sapiens
  misc_feature: GYAE6OF02JUNFO.21.4.A04.1.454.CMB.1.raw
  modified_base (290)..(290): a, c, t, g, unknown or other
  misc_feature (290)..(290): n is a, c, g, or t
  modified_base (484)..(484): a, c, t, g, unknown or other
  misc_feature (484)..(484): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagtcttgggttttcctgttgttattttacgaaggtgtccagttgtgaggtcgcaggctgggtaggagtcggtgggggacgtacgttcggccacgtccgtgggtacgggtccctagacgtacctccgtccgtgtgcctacggcctntggctatttccacctttcgaggtacaaccaactaacgtacgtcgggtacgtcggtacccgacgacggtccctacgggaaggggacgggtcttacggggaggttccggggaccgggtaccttaaggttaaacggaaacggtaaacgtcctaaacggttacgtaaccggagtaacgtaaaggtaaaccgtccgggngttaaccgtcgttaacggtaagggtaaaacgggttaaccgttaccaacccggttaaacgtacccggttaagaaacggaagttacgttaaggtaacttaacgaaaacggttccctaagtacggttatacgtaccagtaacgtaaacgtacggaacctacgtaacggtaaacggtaaaccggacggtacccgaccggttaacttacgggttaccttaggtttaacggaacggggttaaaccaaacggtaaacgggttcggttaaggttaccgttagggggtcgttaaggttaccggtacgttacggtaaaccg

SEQ ID NO: 146912 - DNA, 637 bp, Homo sapiens
  misc_feature: GYAE6OF02FRJ07.21.4.A04.1.454.CMB.1.raw
  modified_base (152)..(152): a, c, t, g, unknown or other
  misc_feature (152)..(152): n is a, c, g, or t
  modified_base (269)..(269): a, c, t, g, unknown or other
  misc_feature (269)..(269): n is a, c, g, or t
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
tcagtcgtcgctcgcacgaccggtgctcgatttagagtagtgatcaggggaggaggctgctcagttaggacccagaggggaaccatggaaaccccagcgcagcttctcttcctcctgctactctggctcccgaggctcagaaaccaccgganaaattgtagttgacgcagttcctcaggcacctgtctttgctacgaaggggaatacgccaaccctcttcctgcagcctaccgagacccgaatattaacctaccagacgactacctaancttacgctggtaccagcacgaatccgtgacctggctacccgaacggttcctacggatactancgtcgtcggtccagaccgggccacggnggaccacctccgactaccgngtacgcgtggaccncggttgggcgttaggactaacgggtccttacgctaccgtcagttcacttagtcaggtctggactctacggatactcgtactacggttatacgttaacgtcgttaccgagtaccgtaattaggtacgttacggtacgttaccttagtccggttagttaccgggtactaacgggtaacctaaggggtactaaaggaacgtaaccgttaagttacggacgtacggtagaccgtaaccgtctacggtac

SEQ ID NO: 146913 - DNA, 1012 bp, Homo sapiens
  misc_feature: GYAE6OF02IR7CX.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggataaagttgtagttgacgcagtcctccgaggccacccgtgtctttcgtacgtccgaggggaaactctcccaccctctcctcgtcacgctccgagccgaagtaactactccgaagtacgccgtaactacgtaatacgtccgttacggaacctacgaccgtaaacggaaccggtccgtacggaccccgacggtccccgttaaccccgtaagggtttcccctacctaacgttaccgtttaaccgtacgggtcccgttacccggggtacccctaacgggtaccgggtacccctaacggttcggaaccctacggtacccccgtaaggtaaccgttacggtttaccgtaacggttccggtaccggttagggttaccggggttacggttaaccggggtaacggttaaccgttaaacccgggtttaccctaaccgttaccgtttacccgaaacgtttaccggttaaacggttttaaccgaacccgggtaaaccggtaccgggttacggggttaaaccgtaccggttaacggtaaacgtttacggtttaacccggttacgttacgggttttaacggtttaaccgtttaaccgggttaccggtaccggttaaccgttaaaccgggttaacgggtttaacggtttaaacccggggttaaacccgttttaccgggtacccggtttaacggtttttaccgggtacccgggttttaacccgggaaacccgggtttaacccggggtaaccgtttaaaacggggttaaactaaaaacccgggtttacgggtaaaaacccgttacgggttaacgggtttacccggtaccgggttacccgtaacccgggtttaaccccgttaccggttacccggtttaaacccgg

SEQ ID NO: 146914 - DNA, 771 bp, Homo sapiens
  misc_feature: GYAE6OF02J1OSU.21.4.A04.1.454.CMB.1.raw
  modified_base (93)..(93): a, c, t, g, unknown or other
  misc_feature (93)..(93): n is a, c, g, or t
  modified_base (160)..(160): a, c, t, g, unknown or other
  misc_feature (160)..(160): n is a, c, g, or t
  modified_base (295)..(295): a, c, t, g, unknown or other
  misc_feature (295)..(295): n is a, c, g, or t
  modified_base (537)..(537): a, c, t, g, unknown or other
  misc_feature (537)..(537): n is a, c, g, or t
tcagtcgtcgctcgcacgaccggtgctcgatttagagtagtgatcaggggagagctgctcagttaggacccagagggaaccatggaaaccccngcgcagcttctcttcctctgctactctgctcccaggctcacgaaccacggagaacttggtgtagacncgtacgtctccgacggctaccctggttccttggcctaccgaaggggaactactcccacctcgtccgtcgcacgcctcgacgacacgtatactcgacgtagacttacctacgacgtaaccgtccgtcggtaacccnggaccgtacgaaccggtccggaacggtcccgaaacggtccccttacccgggtacggttaccctacgtacggtaccgttaacgtccggtacccgttacccggggaccccttaaacggccccgggtacctaacgggacgtccccgtaacggttaccccgaaggttacccgtaccggttcggtacgtccgggaagttaccgggtacggttcgaacgggtacctacggactttccccgaagttccnctaacgtactacgacgtacgtaacgcggtacgtacgtacgtagtaccgtagtcgtacgtagtacggtactgtctaaccgtcgtagtacgtacggtaacgttccgtacgtccttacggttacgtcggttaccggaaccgtaggtacgtaacggtaacggtaacgtaacggtaacgtttacggaaccggttcgttaaccggtcccgtaaccgtaccgttcggtacccgtttaccgg

SEQ ID NO: 146915 - DNA, 809 bp, Homo sapiens
  misc_feature: GYAE6OF02GJZEO.21.4.A04.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccgaaggggaaancgcccaccctctccttgacagcctccacgaccaagaactactaccgagaagccttaactacagtacgtacccttgggtacccaggacaaggaaaccgtcctacgggacccgacgggacccttccccggtaacggtttccctactaattccttacgtcggtaccgttccggggtacccccaaggacccgggggtaccttaacggtcggtactacctacccgaagtaacccgtaggtttcaacgggtcggacgtaggggtttcgggtaccggttaggggacctaaacgtccgtttacaacccttccgttactaacgttaccgtagttacgaccgtagtacggtacggaacgtcgtaacgtaagttacgtttcgacgtaagtttacgttaagttaccgtagtccgaacgttcggtaagttaacgggtaacgttaaccgttaccgttaaccgttcggttttacggtacccggggtttacggacccgggttaacgggtaacccggtaaaggttaaacgggaaaacggtttaacggaaaaacgggtaacggtttacggtaccgggttacggttacccggaccgttaaacccggttcgttacccgtttaccggg

SEQ ID NO: 146916 - DNA, 807 bp, Homo sapiens
  misc_feature: GYAE6OF02IBEI7.21.4.A04.1.454.CMB.1.raw
  modified_base (295)..(295): a, c, t, g, unknown or other
  misc_feature (295)..(295): n is a, c, g, or t
  modified_base (532)..(532): a, c, t, g, unknown or other
  misc_feature (532)..(532): n is a, c, g, or t
  modified_base (602)..(602): a, c, t, g, unknown or other
  misc_feature (602)..(602): n is a, c, g, or t
tcagtcgtcgctcgcacgaccggtgctcgatttagagtagtgatcaggggagctctgagagcggagccccagcccccagaattcccaggtgttttcatttggtgatcagcactgaacacagaggactcaccatggagtttgggctgagctgggtttttcctgttgttattttacaaggttgtccagtggtgaggtgcaggctgggtggagtcgtggggggatacttgggtccaggcccttaggggacggggttcccctaggaggtaccttccgtcgttcgtcgacacgtcccctntacggacctattaccaaccctttgaacgttcgaaccctactaaaaccgtagtcggggacccgttacgggggttcccccggaccaaggggtcccgtacccggtaagggggggaacgggggtccgttaggggaccggggttcggggggtccggtacccggttaaacgtttaaccggaaaagggtaaacgaccgttaaaccaaggtttaaccaacggttacgaagtaacgttaaccgggngtccggtactaggtacgggaaaagggtaacggtaccaccgttacgtaccgtacgaaagtacgtagtaacncttaaacggaaactaaccgttacaggttaacttacgacgtccgaaagtaaaccttcggaaaaccgtacgtaacccggtaacgaaaacccgggacggtaaacccggaccggtcccgtaagttacgttgttaacggtaacggaaacggtacggtaaaacgtgggttacgacggtcggttaggggttaccgggtgtacgtaggtacgg

SEQ ID NO: 146917 - DNA, 728 bp, Homo sapiens
  misc_feature: GYAE6OF02JV91D.21.4.A04.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagagtagtgatcaggggagctctgagagcggagccccagcccctagaattccccaggtgttttcatttggtgatcagcactgaacacaggaggactcgaccaagtggtaggtttgggctggagtcttcgggttttccttgttgtttatttactaggtgtccagtgtgaggtgcagcgtggtgagtcggtcggggaagtctggtccgacgccggtggtacgggtcccnggacgtacctccgttcgtgttgcctacgcctcgtgacctatcctaccttcacgtgaacccacgactagtaggaccggtcggtaccgccgaccggtccggaccggtacggggaacgggcgtagggtacggtcgggtccggtaccgtaacggttaagaaagggaacgtactaaggtaacgtaacgtaacgtaacgaagtaacgtaccgggacgtcgttagtaagggtagtaaacgggtaacgtaccgtaaacgtacttactaggaacgtaagacgtaagtactaacgtaacgtaactacgtaacttagtacgttacgtacgaacgtaagtaacgtaacgaacgttaaccgaacggtaaaccgaacggtacccgtaccgggtaacgttacgttacgttaggttacggtaacggtaagtaaccgtaaaggtagtaacggtggtaggtacggttggtacgtacggtcgtacgg

SEQ ID NO: 146918 - DNA, 785 bp, Homo sapiens
  misc_feature: GYAE6OF02JJRZ8.21.4.A04.1.454.CMB.1.raw
  modified_base (332)..(332): a, c, t, g, unknown or other
  misc_feature (332)..(332): n is a, c, g, or t
  modified_base (508)..(508): a, c, t, g, unknown or other
  misc_feature (508)..(508): n is a, c, g, or t
  modified_base (627)..(627): a, c, t, g, unknown or other
  misc_feature (627)..(627): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccagtggtagtttgggctgagtcgttgggttttccttggttgttattttacgaaggttcgtcctaggtgttgaggtgcagtcgtgggtggagttcggtagggggacgtacttcgggaccaggtcccgttggggacggtccctgacgtacctcctcctgtcgcgacgtccttcgtgctacttccgaccttgacgttcgacccaanaactagtcgggtaccgtcggtccacggcggcctacggaggggtacggcgtggaggtcggggtccgtacgtataacggaaagtaacgtcctaaacgagttacgagtaacgaggtaaacgtccggacgtccggtagtacgggaaagtaaacgggtacttaccgaaacctgtaacgtanaaacggttagaacgtaacgttacgtaaaccaaaggttacctactaacgttgttaccgtacgtacgaaactaacgtaaggtaaacctaaccgggtaaagtaaacccgggtaaaaacccgnggggtaaaccccccgttaaggggttaccgttaacttttacggttaacgggtacgggttaaacggttaaaagggaaaaaccttaacgggggtactttaacggggtacggttaagggggtttacggtacgggttaacggttccggtttaaggggtaaccc

SEQ ID NO: 146919 - DNA, 929 bp, Homo sapiens
  misc_feature: GYAE6OF02H13FI.21.4.A04.1.454.CMB.1.raw
tcagtcgtcgctcgcacgaccggtgctcgatttagagtagtgatcaggggagctctgagagcggagccccagccccagaattcccaggtgttttcattggtgatcagcactgaacacagaggactcaccatggagtttgggctgagtcttgggttttccttgttgttatttacgaaggttgtccagtgtgaggtgcagtcgtggtggagtcggtgggggagtacgttggccacgccggtagggacgggttccgtaggacgtacgttcccttcgtcggtcgacgcgtcccttcgtcgacctacgtttaccctacccgtttacgacggttaccgaacccaaaccgtaaaccgtaggtaccggaccggttacggggtccccgaccggtacgggtaccccgtaccgggaaggggggtaaccggggtcggttagggggtacgggtcgggggtacccggtaccggttaaacggttaaacggaaacgggtaaacgtaccttaaaacggtacggttaaccgtaaggtaaacggtaaacggtaaaccggtaccggggtaccggttaccgggttaccgtttaagggggtaaaacgggtaaacggggtttaaccgggtttaacccaaacccggtttaaagttaccccggttaaaaggaaaggttaaacggtaaacgtttaacggtaaacctttaaaccggaaaaccgtttaaaccgtacgttaaccgttaggttaactaccggtaacgtaacttaaaacgtaacggtaaacccgtaccggtaaacccggtaaaacgggaaacccgacgggtaaccggtaccgggtaacgttactttagttaaccggttgggtaaacggtaaaccggaaattaaaacgggtggttagggttaacggttgggggttacgggttaacgggttacacgggtttccggtaaacgg

SEQ ID NO: 146920 - DNA, 680 bp, Homo sapiens
  misc_feature: GYAE6OF02GZYT6.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccgggagaaattgtgttgacgcagtctccaggcaccctgtctttgtctcgaggggaagagccacctctcctgcagctccgagccaagaactactcgagacgctaactacatacgcctggtaccagacaagaacgcctggccgaggcctacccgtaggttccctcacttctatcggcgtccgggtccacgcggggacctacgtcggactaccgtcccgagtaacgtacggttacgaagggttcggcgtagggtcggggttcgtaggggaaccgtaggttaccttacgtactccgtacgtacttactaacgttacgcgtaaggtacgtagggacgtccggtagtaacggtacgttacggttctaaggttacgttacgttacgttacgtacgaacgtacgtaagttaggtaacggttaacgttacgtaaccgttcgttacggttaccggtccggtaaccgtacggggaaccttaaagggtaaggtaaaacgtacgtaaacggtaccgttaggtacggcgtacgaccgacctacgtcgtacg

SEQ ID NO: 146921 - DNA, 774 bp, Homo sapiens
  misc_feature: GYAE6OF02JXIXF.21.4.A04.1.454.CMB.1.raw
  modified_base (212)..(212): a, c, t, g, unknown or other
  misc_feature (212)..(212): n is a, c, g, or t
  modified_base (234)..(234): a, c, t, g, unknown or other
  misc_feature (234)..(234): n is a, c, g, or t
  modified_base (363)..(363): a, c, t, g, unknown or other
  misc_feature (363)..(363): n is a, c, g, or t
  modified_base (602)..(602): a, c, t, g, unknown or other
  misc_feature (602)..(602): n is a, c, g, or t
  modified_base (760)..(760): a, c, t, g, unknown or other
  misc_feature (760)..(760): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggctcccaggctcagaaccacggagaattgtgttgacgctagtctccgaggctaccctggttctttctacctaccggaaggggtaagacncccgaccctccgtcctagaccngtcctacgacgaccgtaagaacttactaccgaagtacgaccttactaacctagtaaccgtcgttacggtacccgaaggaccaaggtaacgccgtacggtaccgacggtacctacccgtaggttccctancgttactagtccggcgtaccggtccacgggtacggacctcggtggaccctacgaccgtaggaccggtacggttacgacgggtcggtacgtcgggtcgggtacgacgggactacgttactaccgtaccgttactacgtataacgtactaccggtagacgggtaccttacggggactaacccgttaggtaaagttccggttaccggtacgttacgggttacgtttaacgttaacccggttntaccggttacgtccgtaaggttacgttaccgggttagttacccggttaaccggtttcgtacggttacccggggtacggtaacccggttaggtaaaccggtacggttaaggacgttaaacggaccgttaaggtggtaaccgtcggtaccgacgttaacncggttacgttaccg

SEQ ID NO: 146922 - DNA, 655 bp, Homo sapiens
  misc_feature: GYAE6OF02IAP1Y.21.4.A04.1.454.CMB.1.raw
  modified_base (199)..(199): a, c, t, g, unknown or other
  misc_feature (199)..(199): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
  modified_base (512)..(512): a, c, t, g, unknown or other
  misc_feature (512)..(512): n is a, c, g, or t
tcagtcgtcgctcgcacgaccggtgctcgattttagagtagtgatcaggggagagctgctcagttaggacccagaggaccatggaaaccccagcgcagcttctcttcctcctgctactcctggctcccaggctacaagaaacccaccggaagaaattgtgttgacgcagtctccaggcacctgtcttgctcgagggaancgcaccnctcngcagctccagccagtaatactaccagtanccgtaacacgtatacgcgttacgaacctagcgacgtaacgtcctaggcccaggacctcccgtaaggttccactagtcttaagngtccgtcgggtaccccaagtacggacctacggtaggaccaacgtcccaaggtaccaacggtttcgaacggtggccgtaagggtcggtagtacgggtaccagtacttcgactccttagactactaagttacgataacgactacggtgtaccgtagtaacgtagttaccgtacgtagttacgttaattacgngtaaccgagttacgtaaggttagtacggtaacgttcgtaccgttcgttacggttcgtacggtacccggaaggttaaccgtaacggtaagtaaactaggaaaacgttacgtaggtcgtacgttacgactaccgtactcgttacg

SEQ ID NO: 146923 - DNA, 806 bp, Homo sapiens
  misc_feature: GYAE6OF02HKA6U.21.4.A04.1.454.CMB.1.raw
  modified_base (167)..(167): a, c, t, g, unknown or other
  misc_feature (167)..(167): n is a, c, g, or t
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggaggtttgggctgagcgttgggttttcctggttnttattttacaaggtntccagtgtgaggtncagctgggtggagtcggtgggggagtacgttgggaccagtccgtgggacgggttccctaggacgtacctctccgtggtgccgagtccctctagtctaactttccaccgtttacagtaccgtaacccaacgaaacctgttaccgggtacgtcggggccctaccgggcggtcccgtccggaagggggaacgggtcgtaggggtaggggtccgggtccggtaacttaacggtaaacggaaagggtaaaacacctaacggtaacgtttaaccgtaaggtaaacgtaacggtaaacggtaccgggtccggtacgttaccggtagggttaacgggaaaagggttccggtttaaccaaccgtaagttaccccgtaaagtaacgggagtttaaacgtacggttaaactaaaccgtaaaggttacccttacgtaaccgtttagtacctactaacgaaactaacgttacgaaacctaccgggtacctaaaccggaaacccggaacggttcccgaacggtacgtttagtacgtttaacggttggtaaagggttaacaaacggtaagggacggttagttagggtaaccggggtggtttaacccgtaggtcgttaaggtaccg

SEQ ID NO: 146924 - DNA, 706 bp, Homo sapiens
  misc_feature: GYAE6OF02FIF8M.21.4.A04.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
  modified_base (444)..(444): a, c, t, g, unknown or other
  misc_feature (444)..(444): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcacctgtctttgtctaccgaggggaaanctccacctctcctgcagcctccacgccaagaatactccagagctactacatagcctcggtaaccagtacaagaagcccgtggcccaaggtcctacccccgtaggttccctanacgttctaacgtcggtaccgtccgggtacccacgtacggggcccacgtcggcaccgtacccagacgtacggtcgaggtcggacgtagggtcgggttcgtaggggactaaggtaccttcaccgttctacatntaacgtacgacagtacgtacggacgtccgtagtaacggtacgtttcgaaccgttagttacgttaagttaacgttcgtacgtacgtactaacggttagtacgggttaactttaccggtaccgttacgttaacggttaccgggttaccggtaaccgtaaccgggtaaccggtaaacggttaaaggaaacggttaaacggtaaaccggttaaacggtacggtacgtacggttaccggaaccgtaaccgtacgttccgtttaacgg

SEQ ID NO: 146925 - DNA, 790 bp, Homo sapiens
  misc_feature: GYAE6OF02JZIEK.21.4.A04.1.454.CMB.1.raw
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (455)..(455): a, c, t, g, unknown or other
  misc_feature (455)..(455): n is a, c, g, or t
  modified_base (541)..(541): a, c, t, g, unknown or other
  misc_feature (541)..(541): n is a, c, g, or t
  modified_base (587)..(587): a, c, t, g, unknown or other
  misc_feature (587)..(587): n is a, c, g, or t
tcagtcgtcgctcgcacgaccggtgctcgatttagagtagtgatcagggagctctgagagcggacgccccagccccagaacttcccaggtgttttcatttggtgatcagcactgaacacagagacctcaccatgggtagtttgggctagacgtccgttcgggttttaccttaggttacgttattttacgaaggttcgtaccagttgtggtaaggtgacnggtctgggtagtacgttggtagggggactacgttcggtaccacggtccgtgggtaggttccccagtacgaccttctacgtgtcgcacgtcctcaggatcttccgaccttnaccgtaccactacagtagtccggagttccggccaggtccgtcgtacggaaggggacggtcgtaggtacggtcggtcgtaccgttacgtaacgaacggcttaacgtaaccgtgttaacgtaacgganaacgtaacccggttggccttaacggtcgtaacggttagggaacgttaacgttcgtaacccgttgtacgtaaacggaacgttagtanaacccgttaaacgtacgtaaccggtaactttaccgcggttttaaancgttaccctagggtaaaaccctagttaaacggcccctaaaccggttaacccggtaaaccggtaaaccgttaccgaacccgtttgggaaaccgtttacgttaacggttcgttaaaccggtaagggaacccggttaaataagggtttaaccggtggtttacggttttaaggcggggtttaactaccgggttacttaaccgggtcg

SEQ ID NO: 146926 - DNA, 685 bp, Homo sapiens
  misc_feature: GYAE6OF02FVQ5F.21.4.A04.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (414)..(414): a, c, t, g, unknown or other
  misc_feature (414)..(414): n is a, c, g, or t
  modified_base (602)..(602): a, c, t, g, unknown or other
  misc_feature (602)..(602): n is a, c, g, or t
  modified_base (677)..(677): a, c, t, g, unknown or other
  misc_feature (677)..(677): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactcctggcctcccaggctcgagaaaccaccgganaaattgtgttgacgcagtctccaggcacctgtctttgtctcgagggaaacncgccacctntcctgcagccgtcacgccagtaattcnccaggancctaactacgatacgccgtaggtaacctaagcctaagaaacgtcccgtaggccccgtaaggtcccgttccccgtaacgggtttccacccgtaacgtttactaccggttgacccgtttcggggtacccaacgggacgggtccaacgttggaccctatccccgagtaccgnggtttaacgcgggttcggacaacggggttggtccgtagggaaacctaggaacctttcgtaccgttcgtacgaacctttagtaacgtttaggacgaaggtacgttgggaactccgttaaacggaacgtatttccggacgtacgttagttaactaacgtcgtatcggagttacgtagtacgtacttaccncgttactcgttacggtccgaacggtacgggaacaggttaacaacgtaggaaaccgttagtcgagactagacctancttagtag

SEQ ID NO: 146927 - DNA, 818 bp, Homo sapiens
  misc_feature: GYAE6OF02JKHHN.21.4.A04.1.454.CMB.1.raw
  modified_base (147)..(147): a, c, t, g, unknown or other
  misc_feature (147)..(147): n is a, c, g, or t
  modified_base (801)..(801): a, c, t, g, unknown or other
  misc_feature (801)..(801): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggnaaattgtgttgacgcagtcctccgagcaccctgtctttgtctccgaaggggaaagcgcccaccctctcagcagcctccagccaagaatacgtacccagtacgactacgtaacataccgcctaggtacccaaggccgtaaggaacgccccgttgggacccctaacgggtaccccttacccccggtaaagggtttttcccccacgtaaaccttccgtttaacttccggaaccgttttcccggggaaccccttaaccggccgggggtaaccctacccggttagggtaccctaccgtaacccccgaagggtaaacccgtggttttacccaagggttcgggtacaacgggtttcgggttacccggtaggtaaccgaaccggtttaaccttcccaacccgttctacgtaacgttacctacgtttacgacgtacgtaccgtaggtacgtacccgttaggtaaccgttacgtttaccggtacgtacgtttaacgtccttaacgttcggacctacggtaccgttaacggtagtttaccggttaagtttacccgtaacgtttccgttcggttaccgggttaccgaaccgggttaccggaacggtaacggttaacggtaaagttaacggaaaccgtacggtacggtacggacgtaccggtaaccncggttactcggtttacg

SEQ ID NO: 146928 - DNA, 722 bp, Homo sapiens
  misc_feature: GYAE6OF02FUYRF.21.4.A04.1.454.CMB.1.raw
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgctagtctccgaggcacccttgttctttgtctacgaggggtaaagcgcccacctctcctgacagtcctaccagacctaagtaactactccgagacgacttaacacaatacgtcctaggtaccagacgaacgacgccgtggacccgacggtcctaccccgtaggttccctanacttntatcggtcgtccgggcccaacggacgggcctacggcggtaccacgtacccgagtacgtcggttacaggtacggcgtaggtcggtagtggaactacgtaccgttacacgttctacacttacgtaagttacggtacgtacgtacggtacgtacggtacgtaacggttagttaccggtacgttaacgttacggttatttaacgtcggtactacgtacgtaaggttagtacgggttacgttaccgttaccgtttcgtacggtttccggttaaccggaaccggtaacgggaaccggttaaaggtaaccgggtaaagtaaccggtaaacgtaaacggttacggtacggtacccgtcggttaacccgtaacttaccgttgtaccggtttacc

SEQ ID NO: 146929 - DNA, 764 bp, Homo sapiens
  misc_feature: GYAE6OF02G1BYJ.21.4.A04.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccgaggccacctgtctttcgctaccgaggggaaancgcctaccgtctccgtagcagcctccagccaagaactactccgagacgacctaacgtagacttacgccgttaggtaaccaggtacaacggtaacgcccgtggacccaaggtcccgtaccccggtagtttccctacgtaaccgttgttacgtccggtacggttccggtacccgaacgggtcggtaccctagggtccgactacccgtacccgacgtacggtcggttcgagggtcggcgttaggggtttcggtaccggtagggtaactacccgtttacttaccgtaccgtaccgttactaacgtcgttaacgtacggtaacgtacggtacgtcgtaaccggtcgttaagtaacggtttcgtacgttaccgtagttaacgtttacttccgttaagactccggttaatacgggtttaacggtacgttacgttaacccgcgtttcgggtccgttaacgggtacggtaaccggtaagggtaccgtaaagggtacgtaacggaacggtttaaccggaacgttttccggagttacccggtactacccggttacgtcgttaccgttaccgg

SEQ ID NO: 146930 - DNA, 737 bp, Homo sapiens
  misc_feature: GYAE6OF02GHC1J.21.4.A04.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctgctcccaggctcagaaaccaccggagaattgtgttgacgcagtctccaggccaccctgtctttgctccgagggaatcgccacctcncctgcagcctaccngccaagactacgccgagacgccttaacctacacttacgggccttagggaacccaggcccaaggtaaacgtcccgttacgggaccccgtaacgggtcccctttacccccggtaagggttttaccccctagactttaccctaagtttcgggtaaccccgttcgggggttaacccccaacgggacggggtcccctaacgttcgggcccaaccgttcccgaacgtacgtacggttcacggggttgccgtaagggttcgggtcgtagggacctaagtcctttaccacgttccactactctaacgtacgctacggtacgtcggtacgtacgtacgtaacgttacgttacgtacgtacgttacgttacgttcgttcgtactacgtacgtacgttagttacgtaccttacgtaccgttcgttacgtccggttaccgacggtaacgggaaccgtaacggtaaacgtaaggtaacgaaccggttaactgggtaccgacgtaccggtacctacgtacttccgttacg

SEQ ID NO: 146931 - DNA, 715 bp, Homo sapiens
  misc_feature: GYAE6OF02JZPUY.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactcgtggctcccaggctcacgaaccaccggagaaattgtgttgacgtcagtctccaggcaccctgttctttgtctcgagggaagactcctacctctcctgcacgctccacaccaagtactaactccaagacgccttaactacattacgcctacggtaaccagacaacgaacggtccgtacggaccgacggtacctacccgtaacggtttcccttaacacgttacctaacgtcgtccgttaccgggttacccaacggaccgggtcccgacgttacgggtaccacccgtaaccgaacggtacgtaacggttcgtaacggtccggtaacggtcgggttacgggttacggacggttacgaacggtacctttacggtacctaccgttacgtacgtaacgttattacgtaccaacggtacgtacggccgtaacgtaggtaacgtacgttacacgtacgtttagttaccgttagtagtacctacgtagtaacgttcgttaaggtacttacgtcttcgtacgtcgtaccggacggtacggacgtaaggtaagtaacctaagtaaacgtcgtaagtcgcgtaacgtactaaccggtactcgtttacg

SEQ ID NO: 146932 - DNA, 764 bp, Homo sapiens
  misc_feature: GYAE6OF02HGS70.21.4.A04.1.454.CMB.1.raw
  modified_base (265)..(265): a, c, t, g, unknown or other
  misc_feature (265)..(265): n is a, c, g, or t
  modified_base (748)..(748): a, c, t, g, unknown or other
  misc_feature (748)..(748): n is a, c, g, or t
tcagtcgtcgctcgcacgaccggtgctcgatttagagtagtgatcaggggagctctgagagcggacgccccagccccagaattcccaggttttttcatttggtgatcagcactgaacacagagactcaccatggagtttggctgagcgttgggttttccttgttgttattttacgaaggtgtccagtgtgagtgcagctggtggagtcgtgggggatacgttggtccaggtcctgggtacggtccctgacgctctccgtgtagcngtcctcgtgacctacttccacctttcagtcgaacccacaactacgtacggtacggttcgggtccaccgtaccggccgtccgggaagggggacggggtctggggaggttcggggtccggtacgttaacgttaaacggaaacggtaagtaccctaaagtacgttaaccgaaacgtacgaaacgtaaacgtacgggcgtacgttcgtaggtaacgtaaacggttaacggttaccacgtaacgtcgtaaacaaaggtatagtaacgtaacttaaacgaaacgaccttaccgtaacgtttagtacttaccggtagtaaaccgttaaatacgtaaaccgtacgaaacccggttaaagggaaaaaccccgggtcgggaaaccgtacccgggttaacgtttaagttacggtttagggttacggttaacgggtaaacgaaacggttaaaaggtcggttaaggtacgttggggttaagggtgttaacccggtntaccgggtataccggg

SEQ ID NO: 146933 - DNA, 880 bp, Homo sapiens
  misc_feature: GYAE6OF02F617T.21.4.A04.1.454.CMB.1.raw
tcagtcgtcgctcgcacgaccggtgctcgatttagagtagtgatcaggggagagctgctcagttaggacccagagggaaccatggaaaccccagcgcacgcttctcttcctctgctactctggctcccaggctcagaaaccacggagaattgtgttgacgctagtctccaggcaccctgtctttgtctccgaggggaacgagcccacctctcctgcacgctccaggtccaagtaatactaccgagtaacgactaactaacaagtacgcctaggtaccagactaaggaacgcctaggaccccaagggtaccctcccgtaacggtttcccacgtaattccgtaactggtaccgttacggggtaccccaagggaccgggccctaaggtcgggacctaacgttacccgaagaacccgtaaggttacgaacggtcgggaccgaaggggtttaccgggtacgtaggggaaaccctaagggttaacctttaccgaaccctttacgtaaccctatttacgtaaacggtttaaccggaccgtaaacggttaacgggttacgggtaaacccgttaccggttaacgggtaaaccgttaaacggttttacggtaaaccgttaagggttaacgtttaaaccgtttacgttaacggttaacgtaacgggtaaacttaacggggtaagtttaccggggtaaagtttccccgtaaaaccgtttccgttacgggttaccggttttaacccgggaacccggtaagggggttaaaccccgaaaggggttaaaaccgggtaaaaaccgttaaagggtaaacccgggtaacggtttaaccgggtaacgggtttacccgtaaacgggttaacccgaacccgttaaccggttagtttaccggg

SEQ ID NO: 146934 - DNA, 710 bp, Homo sapiens
  misc_feature: GYAE6OF02HN1NX.21.4.A04.1.454.CMB.1.raw
  modified_base (205)..(205): a, c, t, g, unknown or other
  misc_feature (205)..(205): n is a, c, g, or t
tcagtcgtcgctcgcacgaccggtgctcgatttagagtagtgatcagggggagagctgctcagttaggacccagagggaaccatggaaaccccagcgcagcttctcttcctctgctactctggctcccaggctcagaaaccaccggagaaattgtgttgacgcagtctccgaggccacccttgtctttgtctccgaaggggaaanacgcccacccgtctctgcagcctaccagccagtaatactaccgaagcgtaccttaactacaatacgaccttacgggaacctaggaccaaggtaaacgtcccgtacggaccgaacgggtccctacccggttacggttaccctactaacttacctagtcggtccgttcggtaccccacggacgggtcctacgcggtaccactacccgaagtacgtacgttacgaggttcggacgtagggtcggtacgtagggactacgtactctacgtactctatacctagtacgcgtaagtacgtaggtacgtacgtagaacggttacgttacgactagttacgttacgttaagtcgagtacgtacgttagtacgttacgtaacttccgtaccgtttggttaccggtcgggttaaccgaacggaacgggttaacgaacgggttaaataaccggtaaacgaaaccggttaacggtggtaccggtacttaaccggacctaaccggtattcccggtacg

SEQ ID NO: 146935 - DNA, 871 bp, Homo sapiens
  misc_feature: GYAE6OF02I7LZ1.21.4.A04.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagagtagtgatcaggggagagctgctcagttaggacccagagggaaccatggaaaccccagcgacagcttctcttcctcctgctactctgctcccaggctcagaaaccacggagaattgtgttacgacgtcagtctccaggcacctgtcttgctaccgagggaanacgccctaccctctccgtgacgacgtcctaccgacgaccgaagaactactaccgagacgtacctaaccgtaactagtacgtaccgttacgggaacccaagtacgaacggtaacgcccgttacgggacctaacgggttaccccgtcccgttaacgggttaccctacttaacttacgttaacgtccggttaccggtaacccggggtttaccccaaccggaccggggaccccttaaccggtcggtaacccctaaccgtaacccggtaggtaacccgttacggtttacgaacgggttcggaaccgtagggtttaccgggtacgtacgggtaacctcgtaaaccgttccgtacctacgtactacgtacgtttaacgtaccggtaacgaaccggttacggacggtacgtaccggttaaggtaaccgttccgttacggcggtttaagttcgttaaacttcggtactaccggtaacggtacttaggttaacgaccggttaaacttcccgtacgtttacggttaccggtaccgttaaacccggggtaccgtaacggggttaaacccggtaaacggtaaacgggttaaaacccgttacgggtaaaaacccggtttacgttaccggggtaaaccgtcccgtttaaaccggaccgggttaaacccttaacggttccgtttaaccg

SEQ ID NO: 146936 - DNA, 697 bp, Homo sapiens
  misc_feature: GYAE6OF02GK946.21.4.A04.1.454.CMB.1.raw
  modified_base (677)..(677): a, c, t, g, unknown or other
  misc_feature (677)..(677): n is a, c, g, or t
  modified_base (690)..(690): a, c, t, g, unknown or other
  misc_feature (690)..(690): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaagaaccaccggagtaaattgtgttgacgcagtctcaggccacctgtctttgtctcgagggaagcgccacctctcctgcagtcctccacgccagaatactaccgagacgactactaacactacgcctacggtaccacgcaagaacgccgtggaccaggcctacccgagttcctctatcctatcgaccgtccggtacccacggtaccgggtccacgtcggacctaccgttacccgaacggtaacgtacggttacgacgggtcggacgtacggggtttggtaccggtacgggactaacggcctttacgaccgttccgtacaacgttcgttaacgttacgccgtaaggtaccggttacggaaccggtacgttaaggtaaccgtagtttccgaacggtacgttacggttaattaccgtgttaaccgtagtactaggtacgttacgtacgttaaccctgttccgtacggtacgtacgggtaccgtaacggtacggtaacgtaaaggtaagtaaccggaaaacgttacgtacggacgtagtacccgtanaccgtttaccgtnttaaccg

SEQ ID NO: 146937 - DNA, 647 bp, Homo sapiens
  misc_feature: GYAE6OF02JWOQ9.21.4.A04.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (369)..(369): a, c, t, g, unknown or other
  misc_feature (369)..(369): n is a, c, g, or t
tcagtcgtcgctcgcacgaccggtgctcgatttagagtagtgatcaggggagagctgctcagttaggacccagagggaaccatggaaaccccagcgcagcttctcttcctcctgctacctctggctcccaggctcagaaaccaccggagaaacttgtagttgacgcagtctcaggcaccctgtcttcgtctcgaggggaaagngccaccctctcctgcacgctccagccgagaatactccganacgctacgacanacgtccgtacggtaccacgacaacggaacgccgtacggtcccgacggctccccggacgttccnctactcgttatacgcgtccggtaccacggcggcacgtcggactacgacccngactggtacaggtcgacgaggttggccgtacgggtagtacgtcttaccgactcgttacactaacgtagtacgtcgtaacgtacgtgacgtccggtataacgtcgttacgacgttcggtaagttcgttaacgtcgtaactacggtcttacgtaaggttacgtaacgtttcctaacgttagttccggtaacggtcgaccggtaaccggtagtacggtaaaggtaacgtacggaaacgttacgtggttaacgtgtaccgtacgaacgttcctagtttaccg

SEQ ID NO: 146938 - DNA, 735 bp, Homo sapiens
  misc_feature: GYAE6OF02HBGD3.21.4.A04.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgtttattttacaaggtgtccagtgtggaggtgcagtctggtggagtcggtggggganacgttggtccagtccgtgggacggtccctgacgtacctctcctgtgcacgcctctcgactattacctaccttcagtacgaccaacaacagtacggacgtcgggtcccgtcgacggcctaccggaagggggaacgggtcggtaggggtacgggtcgggggtaccggtaccggttaagttaacggaaagggaaacgtaccgtaaagtacgttaacgaagtacgaagtaacgtacggcgtacgtcgtagaaggaaacggtacgtaccactacgtactaagaagtagtactagtaaccttaagaaaacgtaaccgtactaacgtacgttacgtacgtacggtaactaaacgtacgtaaacgtaccggtaaacgaaaccggtaaaaccgaacggtacccggtaaaccgggtccgtttagttaagtttcggtttaagggtaacggtaaacgaaaccggtaaaggtagggtaaggttacggttaggggttaagggttggtacccgtaggttaccggtaacg

SEQ ID NO: 146939 - DNA, 770 bp, Homo sapiens
  misc_feature: GYAE6OF02HV5HZ.21.4.A04.1.454.CMB.1.raw
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggacctcaccatggagtttgggctgagcgttgggttttccttgttgttattttacaaggtgtccagtgtgaggtgcagctggtggagtcgtgggggatacgttggccaggtccgtgggacggtccctggacgtactcctcctgtgccagccctntcgctacttccaccttgagtcgaaccacaacngtcggaccgtcgggtcccncgacggtcctaccggaggggagggcgtggggacggtggggtaccgtcgtaagttaaaccggaaggtaaccgtactaaacgtaggtttaacgaacggttaacgaaggtaaacgtacccgggcgtacggttcgtagggtaacggaaacggggttaccttaccaacccgtaagttccgtaaggaaagtaaggtacttaaccggtaaactttaacgaaaacggttaccttaccgtaaacgttcgttaaacttccgtaaagaactaacggtaagaaacccgtacgtacccgtaaaacgggaaaacccgcgggaaacccgtaaccggttacggttaagttaggtttacggtacgggtaagggtaaaaccgaaaacggttaaaaggttagggtaacgggttagtaaccgggggtttagggtacgggttacttaccgggttacgtaaaccgg

SEQ ID NO: 146940 - DNA, 741 bp, Homo sapiens
  misc_feature: GYAE6OF02FZVUX.21.4.A04.1.454.CMB.1.raw
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (422)..(422): a, c, t, g, unknown or other
  misc_feature (422)..(422): n is a, c, g, or t
tcagtcgtcgctcgcacgaccggtgctcgatttagagtagtgatcagggggagagctgctcagttagacccagagggaaccatggaaaccccagcgcagcttctcttcctcctgctactctggctcccaggctcagaaccaccggagaattgtgtgacgcagtctccaggcaccctgtctttgtctccgagggaanctccacctctcctgcacnctccagccagtaactacaccaganctacacatcgcctaggtaccgagacagacgcctcggccacggtcctacccgaggtttccactacttactacgtgcgttcggaccacggacggcctacgtcggaccacgtaccagacgtacgttgtacggtgtacggtagggtcggtacgtacgggaacgtacgtacctccgtaccgttcctacnttacctacgtacggacgtaagtaccggtacggacgttaccgtaacggtacgtacgttaccgtaggttagttacttacggttcgttcggtaaccgtagtaacggttaggttacgggttaacgtttaaccgttcccgtttaaccgttcgggtttaaccgggttacccggtttacccgggtaaccgggtaaaccgggtaaccgggttaaagggttaaacggttaaaacccgggttaaacggttaaacccggacgggttttaacggggttccgttaacccggtagggtacccctaaccggtttacggttacccggtttaccgg

SEQ ID NO: 146941 - DNA, 718 bp, Homo sapiens
  misc_feature: GYAE6OF02J131E.21.4.A04.1.454.CMB.1.raw
  modified_base (221)..(221): a, c, t, g, unknown or other
  misc_feature (221)..(221): n is a, c, g, or t
  modified_base (374)..(374): a, c, t, g, unknown or other
  misc_feature (374)..(374): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcaacgaaaccaccggagaaattgtgttgacgcagtctccaggccacctgtctttgtctcgagggaagacgccacctcgtcctgcagcnccacgacagatactacagacgactactacgatacgccgtacggtaacacgacaaggacctccgtacgggacccgtacgggtacctaccccggtacgttacctacgtacttcctattacggtccggtaccggtacccacggtaccggccgtacncggacctactccgaggacgtaggtcgtacggtcggacggtacgggttcggtacgggtacggacgtacgttaccttacggtactaccgtctacgtactacgtaacgctaaggtccgtgtaaccggtacctaaggtacgttaccgtacggtaacgtacggttacttacgttacgtacggtactacgtagttacgtacgttacgggttaacgtttcgtaccggttcgttacggtttaccgggtaccggtaaacccggttacggaacggtaacggttaacgaaacgtacggtaaaccgtacggttacggtacgacggttaccgtaccgtaacgtcgttacgttaccgg

SEQ ID NO: 146942 - DNA, 854 bp, Homo sapiens
  misc_feature: GYAE6OF02IMQMV.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctagagcttgggttttccttgttgttattttacaaggtgtccagtgtgtaggtgcgagtcgtggtacggagtcgttgggggagtacgttcggtccacggccgttgggaacgggtccctagacgaccttcctccgtgtcgactacgtcccttacgtcgtactactttaccacctttacgaacggtaccgaaacccaaccgtaaaccgtagttacgggtaaccgttccggggttaccccgtaccgtaccggtccgtacccggagggggtaacggggtccgttaggggaggttacggggtaccggtaaccgttagtaaaccgaaggtaaacgtacgttaaacgtaagttaccgaaggtaaccaaaggtaacgtacgggacgtacgtacgtagtaacgggaaacggtacgtttacaacccggtatttacgaaccggaaagtaacgtacgttaacggtaaactttaaacggaaaaacggtacctaaccggttaacgttagttaaacgtccgaaacggtaaccaaaagttaccggaaacaccggttaccctaaacgggaaaaaccgtacgggtaccgaacccgggttactttaaggttaacgttaacggttttacggggaaaggtttaaacccaaaaagggttaaacgttcgggttaaggggtaccgttttacgggggtaggttaacgggttaacccgtcgttttaacgggaaaccgg

SEQ ID NO: 146943 - DNA, 819 bp, Homo sapiens
  misc_feature: GYAE6OF02G8U8G.21.4.A04.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagagtagtgatcagggggagctctgagagcggagccccagccccagaattcccaggtgttttcatttggtgatcagcactagaacacagaggactcaccatggagttgggctgagcttgggttttccttgttgttattttacgaaggtgtccagtgtgaggtncagctggtggagtcggtgggggagtacttgggccaggcccgtagggacgggttccctggacgacttccgtcctgtcgacacgtcctactcgactacgttccacctttcgacggtacaacccgaaccgaaagtacgtagggtaccggtcggggtaccccgaccgagggtcctacccgggaaggggggtaacgggtccggtaggggacgggttcggggtacccgggtacggttaaagttaacggaaaagggtaaactaccgttaaagtacgttaactaagtaaacgaagtaacgtaacgggccgtagtaccgttaggtaacgggtaaaagggtacgttaacccgaacgtacgtaccgttaacgaaacgtaaggttaacgttaacgtaaagttaacgaaaaacggttaaccctacggttaaacgttacgttaacgtccgttaaacgtaactaaacggttaaccgtaaacgaccggttaaccggtaaaccgaaaaccgggccggtaaaccgtacgggtaccgttaagggtttacctttaaggtaggttaacgggtaaaggaaacgtaaaacggtgttaacgggtagttacgggttgggtaaccgggttaggtccgttacggtaacgg

SEQ ID NO: 146944 - DNA, 744 bp, Homo sapiens
  misc_feature: GYAE6OF02FMR2G.21.4.A04.1.454.CMB.1.raw
  modified_base (144)..(144): a, c, t, g, unknown or other
  misc_feature (144)..(144): n is a, c, g, or t
  modified_base (149)..(149): a, c, t, g, unknown or other
  misc_feature (149)..(149): n is a, c, g, or t
  modified_base (157)..(157): a, c, t, g, unknown or other
  misc_feature (157)..(157): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (723)..(723): a, c, t, g, unknown or other
  misc_feature (723)..(723): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcagaaaccncgganaaattgtntgacgcagtctccaggcaccctgtctttgtctcaaggggaacncgccaccctntcctgacacnctccgagcctagaactacgtacccgaggacgtactactaacactacggtccctagggtacccaggctaacggaactccggtggaccgacgggtccttacccggtcggtttacccacgacgttcctaaggttccgccggttacggggtaccccaagggaccggggtaccctacggttcggaccttaaccgtaccccgaaggacccggttaaggtttccgaaggtacgggtacgtaggggttccgggtcggtacgggtaacgtaacggtcctttacgtaccgtacgtctaacgttacgtattaacggacgttaacgcggttaacggacgtccgttaagtacgtttaccgttcgtacggtaagttcgtttaacgtcgttagtccaaggttacggaagtttccgtaggttaacttccgacgttcgtccgggttacgttcccggggtacggtaacggtaccgtaagggtaaacgtaacgttaaacggaacgttacgtaggtcgtaacncgacgtacgtcggtacttccg

SEQ ID NO: 146945 - DNA, 658 bp, Homo sapiens
  misc_feature: GYAE6OF02GRGEM.21.4.A04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctcaggcacctgttcttgtctcgaggggaaancgcctacctcncctgcagcctacacgccagtaactactaccgagacgcctactacagtacgcctggtaccagactaggaacgtccgtcggaccaggtccctccgaggtttcccanactctaagtcgtcgtccgggtacccaacggtacgggaccctacgtggaccctacgtcccgaaggtaccgtaggttcaaggtcggtagtagggttcgggtacgtacggggtactacggtacctttaccgtacggttacctacgtactacgtacttaacggactaacggtacgtacgtacgtacgtaggtacgtactttcgacgtacgtagttacgtacgttgtacgagtacgtagtagtacgtacgttctaccgttcgtacggttacgtaccggtaacgacggtacgaaggttaactaacggtacgaaagttcgtagtacggtcgtaccgactacgtgtcgttacg

SEQ ID NO: 146946 - DNA, 741 bp, Homo sapiens
  misc_feature: GYAE6OF02GSAQ6.21.4.A04.1.454.CMB.1.raw
  modified_base (217)..(217): a, c, t, g, unknown or other
  misc_feature (217)..(217): n is a, c, g, or t
  modified_base (624)..(624): a, c, t, g, unknown or other
  misc_feature (624)..(624): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcagctggtggagtcgtggggganacgttggtccagccgtgggacgggtccctggacgaccttcctccgtgtcgcgacgcctctgctacttccaccttcagtcgaaccaacgaactagtcgggacgtcggggtcccaccgtaggcctaccggaagggggacggggtcgtggggtacggtcggggtaccggaccgttaagtaaccggaaaaggtaaacgaccttaaactaggttaaccaaggtaacaacgtaaacgtaccggtcgtacggttacgtagggtaacgggtaaaagggtacgtttacccaacgtaactacgtaacgaaagtgtaagttacgtaattaaccgaaaaagtaccctaacgtactttacgtaactaccggtagaaactaacgtaacgaaccgtaacgaacccggtaaaggaaaacccgnggtaaaccgtaccgggtaccgtttagttaatttacggttagggtaaacggtaaagtaacggtaaaacggtggtaacgttacggtagggttacgggtagttacggacgttggtaaccg

SEQ ID NO: 146947 - DNA, 683 bp, Homo sapiens
  misc_feature: GYAE6OF02G2RFV.21.4.A04.1.454.CMB.1.raw
  modified_base (503)..(503): a, c, t, g, unknown or other
  misc_feature (503)..(503): n is a, c, g, or t
tcagtcgtcgctcgcacgaccggtgctcgatttagagtagtgatcagggggagagctgctcagttaggacccagagggaaccatggaaaccccagcgcagcttctcttcctcctgctactctggcctcccaggctcgaacgaaacccgaccggaagtaaacgttgtgttcgacgctagtcctccgaggcctacccgttgttctttcgtcgtaccgaaggggaaacgacgccctaccctctcctagccagcctaccacgaccaagaactacgtccagacgtacctactacatacgcctacggacagaccaagacgccgtcggaccacggcctcccgtacgttccacgtactcgttacgtcggtccgtcgggtaccccacggtacggcctagtcgacaccgtacccgagtacgtacggttcgaggtcggacgtcgggtacggtcgacgggactacgtaccttaccacgtcctatactacgtaacttcggacacggtcggcgtacncgtaagtaatcgttacacgttagttcgtattctggtactagaagtcgtaggtactaacggttcctacggttcgtacggttccgtaccggaacgtacgggaacgtaaggttaaacggaacgtaacggtaaaccggtgttacggacggtaccgtacggaccctaacggttacttccgttacg

SEQ ID NO: 146948 - DNA, 690 bp, Homo sapiens
  misc_feature: GYAE6OF02FNJEG.21.4.A04.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattggtgttgacgcagtcctccgaggcaccctgttctttgtctccgagggaacaaccaccctctccngacacgcctccgacgccagtaactactccagacgctactacatagtccgtgtaccgagcaagaacgcctaggccaacggtcctacccgtacgtttccctcgaaccttcgtaactggtccggtaccgggtcccaacggtacgggacccaacggtcgaccgtaactcccgaagaccgtagtcgaggtgacgtaggtggtcgtaggacaacggtcttccgactcgtactaactactaatttaagcctagtaacggtacggactacggtagtaacgtcgtcgtacgttagtcgtttaattaccgtgtacgtaaccgctaaggtacgttacggttaacttaccgtaccgtttacgtccgtttaccggtttcccggaacggttaaaccggtaccggaaaggttaacgaaacggttaacggtaaacgtaccggtaacggtccgtaccgtcgaccgttaaccttagtcccgttaattccgg

SEQ ID NO: 146949 - DNA, 700 bp, Homo sapiens
  misc_feature: GYAE6OF02FRMQA.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctcgaggggaaatgcccacctctcctgcagctccagccagaatactccagagacctactacataacgccctaggtacccagccaagaacgcctaggccaggcctccccgtagttcccagattactatcgtccgtacgggtacccacgacgggcccacgtcggactaacctaccgagtacctaggttactaggtcggtaccgaggttcgggtactcgggaactacggtacctttacgaacctttccgacgtaacgtacgtaacgtttacgacgtaacgtacgtacggtaccgtaccgtaaggtaacgttacgtttacgaccgttaggtttacgttacttacgtagtacgtacgtaccgtaagttagtaccgggttaagttccgttaaccgttcgttacggttccggttaacccgggaaccggtaacgggaccgtaaagggtaacgtaaacgttacgggtaaaccgtacggtacggtacggtacgttaccggacctaccgtaccttacgttaccg

SEQ ID NO: 146950 - DNA, 752 bp, Homo sapiens
  misc_feature: GYAE6OF02G20HD.21.4.A04.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagtcgtcgctcgcacgaccggtgctcgatttagagtagtgatcaggggagagctgcgtcagttaggacccagagggaaccatcggaaaccccagcgccagcttctcttcctcctgctactctggcctcccaggctacagaaacccaccggagtaaattcgtagttagacgcaggtcctcgaggccaccgtgtctttgtacctaccgaggggaaacngtaccacccttcnccgtagccagctaccgagccagaactactccaaggctacttaacacgtagtacgtaccgttcggtaccaacgccaacggtaacgcccgttaggaccccgttacgggcccttaccccggtacggtttaccctactacttacgtagtcgtaccgtccgggtacccaccggtacgggtaccctacgtacggtaccacgtaccccgagaccgttaacggttcgaacggttcggacgtcgggttcgggtacgtcggggaactacgtaccttaccgacttcgtactagttaccgaatttacgaccgtacggtacgttcggacgtaccgtagtaaccgtacgttcggacttaggtttctaagttacgtcgtacgtaacgtcgtaaggtcgttaggtaccgtttacctacttcgggttacgttacccggttacgggaacccgtaacgggtaccggtaaaggtaacgtaaggtaaacggtaacgtaacggtaggtcgtaccgtcgttaaccggactttacggcgtttacg

SEQ ID NO: 146951 - DNA, 799 bp, Homo sapiens
  misc_feature: GYAE6OF02HCNV7.21.4.A04.1.454.CMB.1.raw
tcagtcgtcgctcgcacgaccggtgctcgatttagagtagtgatcaggggagagctgctcagttaggacccagagggaaccatggaaaccccagcgcagcttctcttcctcctgctactctggctcccaggctcagaaccaccggagaattggtgttgacgcagtctccgaggccaccctgtctttcgtctccgagggaagcaccctaccctctcctcgcacgcctaccacgccaacgaactacgtaccgagacgaccgtacctacgacgtacgtccgtaccggttaacccaggtaccaacggaacgtaccggtcggacccgtaccgggtcccgttaccccgtaccgggtttcccctacgtaacgttccgttacggtccgtaaccggtcccggggtaccccgaccggacccgggtaaccgtcccggttacggaccgtaacccttaccccggaacggtaccgtaacgggtttcggacgggttcggaccggttacgggtcgggttaccgtagggaacgtacccgtacgtttaccaccgtcctaacccgttagtacccgttaggtaacgacggacgttacgggtagggcgttaccgggtaattaacgtcggttacgtaaccgttaggttacgtagttacgtcgtagtcgactttaggtcggtagttaacgttccttccggttacggtccgtttacgggacccggtaggtaacccggtaaggtaacggtaaactaccgggtaaaccggtaacggttcggttaccggacggttccgaccggtaacgttacctgttccgttaccg

SEQ ID NO: 146952 - DNA, 790 bp, Homo sapiens
  misc_feature: GYAE6OF02HSAUN.21.4.A04.1.454.CMB.1.raw
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (297)..(297): a, c, t, g, unknown or other
  misc_feature (297)..(297): n is a, c, g, or t
tcagtcgtcgctcgcacgaccggtgctcgatttagagtagtgatcaggggagctctgagagcggagccccagccccagaattccccaggtgttttcatttggtgatcagcactgaacacagaggactcaccagtggagtttgggctgagcgttgggttttccttgtttgttattttacaaggtgtccagtgtgaggtgcagcgtggtggagtcggtgggggagtcgttggtccgagccgtgggacgggttccctgacggaccttctcctggtcgacncgcctngctattccaccttnagtcaccacaacacgtcggacgtcggtcccgacgcgggtcctaccgggagggggacgggtgtacggggagggttcggggtcccgggtaccttaagttaaacggaaagggaaacgtacctaaacgaggttaactacggaacgaaggtaacgtaccggggaccgttacgttacggtttagggaacgggaaaaacggggttaccggtttacccaaacctaccgttaacgaaaccggaaaacgggttaataggttacggttaaattaaaccgtaaaacgtaacccttacgtaaacgttttgaaccgttctaacggaaccttaaaagtccgaaaacggtcgtaaacccggtaaaaggaaaccccggaaggggtacccaaccgggttccgttaaatttacggtttagtttaccgggtaaaggttaacggaaaaccggaaggtaagggttacggttaagttgggggttacggttaggggtaacgtcgggttcttaacggg

SEQ ID NO: 146953 - DNA, 740 bp, Homo sapiens
  misc_feature: GYAE6OF02GJ1B5.21.4.A04.1.454.CMB.1.raw
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (582)..(582): a, c, t, g, unknown or other
  misc_feature (582)..(582): n is a, c, g, or t
tcagtcgtcgctcgcacgaccggtgctcgatttagagtagtgatcaggggagctctgagagcggagccccagccccagaacttcccaggtgttttcatttggtgatcagcactgaacacagaggactcaccatggagtttggctgagcttgggttttccttgttgttattttacaaggtgtccagtgtgaggtgacagtcgtggtcggagtcggtgggggatacgttggtaccgagccgtgggacgggtccctggacgacctctcctggtncgacgtcctctgactattccgtaccttntagtacgaaccactaacacgtacgggtaccgtacggggtcccgaccgacggtccgtaccgggaggggaacggggtcgtacggggtagggttccggggtacggtaccgttaagttaacggaaaacggtaaacgaaccgttaaacgtagtttaaacgaacgtaacgaaaggtaaacgttacgggccgtacgggttacgttacgggtaaaggaaaacggggttacgttacccaaaccgtagttccctaaaggaagtagtacttaggtaataacggaaaattacctnaagttacgttactcgtacgaacgtaaattacgaacctacgaacgtaaccgggaaaccgtacggaaccgttaccgggactttagttacttaacgttgggaaacgtaacgaaagtaacggtgttagacggttggttagggtaagttactgtacggtaacg

SEQ ID NO: 146954 - DNA, 711 bp, Homo sapiens
  misc_feature: GYAE6OF02ICPL4.21.4.A04.1.454.CMB.1.raw
  modified_base (213)..(213): a, c, t, g, unknown or other
  misc_feature (213)..(213): n is a, c, g, or t
  modified_base (274)..(274): a, c, t, g, unknown or other
  misc_feature (274)..(274): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagtcgtcgctcgcacgaccggtgctcgatttagagtagtgatcaggggagctctgagagcggagccccagccccagaattcccaggtgttttcatttggtgatcagcactgaacacagaggactcacatggagttggctgagtcttgggttttccttgttgttattttacgaggtgtccagtgtgaggtgctagcgtgggtggagttcggngggggtatacgttggtaccacgccgttgggacggtccctggaacgtcttcctctgtcgacncgtccgtntgactcttaccnccttacgagtacgtaaccacgaacctagtcggtacgtcgggtcccncgacgcgtaccgagggtaacggcgtgggacggtcgggtaccggtacgttagtaacgaaaggaacgtctaaacgtagtaacgagtaacgaagtacgtaccggacgtacgttcgtagggtaacggtaaacggtaacggttaccaacgtcggtactacgaagaacgttacgtagtacgttaacgaaacgtaacctatacgtagttaatcgtaggtaacttaaacaacggtaactaccgtaactaaaccggtaaacgacggtaacccgtaacgggtacccgttaagtacggttacggttacggtaaggttaacgaaagtaaaacggtaggtaggtaacgtcgggtacggttagggtacggtcggttagtaaccgg

SEQ ID NO: 146955 - DNA, 772 bp, Homo sapiens
  misc_feature: GYAE6OF02F649C.21.4.A04.1.454.CMB.1.raw
tcagtcgtcgctcgcacgaccggtgctcgatttagagtagtgatcaggggagctctgagagcggagccccagccccagaattcccaggtgttttcatttggtgatcagcactgaacacagaggactcaccatggtagtttgggctgagtcgttgggttttccttgttgtttatttacgaaggttgtccagtgtgaggtgcgagcgtgggtggacggttcggtgggggacgtacgttcgggtccaggccgtacggggaccgggtcccctaggacgtaccttccgttccgtggtcgtacctacggtccttcgtcgaccttacgtttcccgtaccctttcgacggttacgaaccctaacaaccgtagtaccgggtacggttccggggtccccgaccgaccgggtccgtacccgggaagggggtacggggtcgtcggggtacggggtcggggttaccggtaccggttaacgttaaacggaaacggtaaacgacgttaaacgacgttaacgtaacggtaacaaacggtacggtaccggtccggtacgtacgggttagtaagggaaacgggttaccggtacctaaccgtacgtaccgtaagaacgtacggaattacggtaacttaacgaacgttaacctacgtaaccttcggttaactcgaacgtaagtaaactcggaacgtacgacggtaaacgaaacgacgacgtacgggacttgttacgtgtacggtaagaagtaagaaggtagtagaggttaggtaggtgtagttgtaggtacg

SEQ ID NO: 146956 - DNA, 834 bp, Homo sapiens
  misc_feature: GYAE6OF02JDFF9.21.4.A04.1.454.CMB.1.raw
  modified_base (121)..(121): a, c, t, g, unknown or other
  misc_feature (121)..(121): n is a, c, g, or t
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagtcgtcgctcgcacgaccggtgctcgatttagagtagtgatcaggggagagctgctcagttaggacccagagggaaccatggaaaccccagcgcagcttctcttcctcctgctactcnggctcccaggctcagaaaccaccgganaaattgtgttgacgcagtctccaggcacccgtgtctttgctcgaaggggaaancgaccacctctccngcagcctaccagcccaagaactactccaaggactcctaacaactatacggcccttagggtaacccaggaccaaggaaacgccctagggaccctaaacgggtccctaccccgtaagggtttcccacgtaaacttccgttaatcggtacgttcggggttaccccaaacggacggggtaccctaaggttcggacctaaccgtacccgaaaggtaaccggtaggttttacccgaaaggggttccgggaccgttaaacgggttttggggaccccgttaggggaaccctaaggttacctttccgaaaccttctacgtaactacgtaagttacgaccgtaagacgtacgggtacgtacccgttaagtaaacgttacgtttacccggaacgttagggtttacgttaaagtttaacccgtacggttaccgtaaggtaccgttaacggttaaggttaaccgggttaaacgttttacccgtaaccgtttcgtttaccggttaccggggtttaacccggaccggtaaaccgggtaaccggtaaagggttaaacgttaaaacggttacggaaaaccggttacgttacgggacggttacggaacgtaacccgaacttacggttactttaccgg

SEQ ID NO: 146957 - DNA, 811 bp, Homo sapiens
  misc_feature: GYAE6OF02HD6LR.21.4.A04.1.454.CMB.1.raw
  modified_base (90)..(90): a, c, t, g, unknown or other
  misc_feature (90)..(90): n is a, c, g, or t
  modified_base (598)..(598): a, c, t, g, unknown or other
  misc_feature (598)..(598): n is a, c, g, or t
tcagtcgtcgctcgcacgaccggtgctcgatttagagtagtgatcaggggagctctgagagcggagccccagccccagaattcccaggtnttttcatttggtgatcagcactgaacacagaggactcaccatggagtttgggctgagtcgttgggttttccttgttgttattttacaaggtgtccagtgtgaggtgcagcgttgggtggacggtcggtagggggagtccgttgggcccagggcccgttagggaccggggtccctaggacgtacttcctccgtggtcgcctacgtcccctactcggacttacgttcctaccttcgaagtccgaacccaacaaacctagtacggaccggtaccggggtccccaccggacgggtcccgtaccggggaacgggggaacggggcgttaaggggacgggttcgggggtaccccggtacgttaaacgttaaaccgggaaaacggtaaacgttaccgtaaacgttaacggtttaaaccaggttaaaccgaaggtaaaccgtaccggaccgtcgttacgtaacgggtaaggaaacggggttaaccgtacaacccgtaagttaccctaacgaaaggtntaacgttgtaacgttaacaaaggtacctactagtcgtattccgagaacaaagtacgaaccgtacggtactaaaccggaaaccgtggaacccgtaacgggtactttagggtattttaggttacggtaacgggtaagtaaaacgtaaacggtagggtttaacggaagggttttacggggaagggttacgggttaaccgtgggttaaccgtaacgg

SEQ ID NO: 146958 - DNA, 770 bp, Homo sapiens
  misc_feature: GYAE6OF02G24BU.21.4.A04.1.454.CMB.1.raw
  modified_base (192)..(192): a, c, t, g, unknown or other
  misc_feature (192)..(192): n is a, c, g, or t
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagtcgtcgctcgcacgaccggtgctcgatttagagtagtgatcaggggagctctgagagcggagccccagccccagaattcccaggtgtttcatttggtgatcagcactgaacacagaggactcaccatggagtttgggctgagcgttgggttttccttgttgttattttacaggtgtcagtgtgaggtncagctgggtggagtcgtgggggacacttggtccagccgttgggacggggtccctggagtacctctaccgtgtacgcagtcctntgactacttcctaccttcgagtacgacctanaaccagtcggacggtcgggtcccgccgacggccgtaccgaaggggggaaccggggtcgtcggggaagttcggggggtaccgggacccgttaacgttaaacggaaaagggtaacaaccgtaaagtagttaaccgaagtaacgaagtaacggtaccgccggttacgtcgtagggtaaaggaacgggtaacgttaccactaagtcgtaacgaaaggacggtaagtacggttaactacgtaaaacgttaactacgttaactagtttacgtacgtaaggtaacctaaaacgggtaccgtaaacgtacgaaaccccgggttaaaggaaaaaccccgggttaacgggaaaccgttaacggggtaacccgttagtttaacgtttaacgttggttaaacggggtaaaccgtaagtaaaacgggtgggtaacggtaggttacgggttggaccggtttagccggttgggtaaccc

SEQ ID NO: 146959 - DNA, 533 bp, Homo sapiens
  misc_feature: GYAE6OF01DRPNP.21.70.G04.1.454.CMB.1.raw
  modified_base (528)..(528): a, c, t, g, unknown or other
  misc_feature (528)..(528): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggaccgcagtcaccgtctcctcagcctccaccaagggccccatccggtcttccccctcggcgcccctgctccaggagccacctccgagacgcacagcggccctgggctcgcctggtcaggactacttccctcgtctctactgacgcgggctggnaacgg

SEQ ID NO: 146960 - DNA, 531 bp, Homo sapiens
  misc_feature: GYAE6OF01ACSIJ.21.70.G04.1.454.CMB.1.raw
  modified_base (422)..(422): a, c, t, g, unknown or other
  misc_feature (422)..(422): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgcctattacggtatggacgtcgnggggccaagggaccgcagtcaccgtctcctcagcctccaccaacggcccatccgtccttcccccgtggccgtccctgcctcccgaggacgccacctccgacgcgcaccg

SEQ ID NO: 146961 - DNA, 525 bp, Homo sapiens
  misc_feature: GYAE6OF01DFLWR.21.70.G04.1.454.CMB.1.raw
  modified_base (444)..(444): a, c, t, g, unknown or other
  misc_feature (444)..(444): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtggtattggctactcgccctattacggtatggacgtctggggccaaggggccgcagtcaccgtctcctcagcctccaccaagggcccatcggtcttcccctggcgccctgctccaggancacctccgagacgcacagcgcccgtgggctgcctggtcaaggactacttccctcgtctctactgacgcgggctggcaacgg

SEQ ID NO: 146962 - DNA, 556 bp, Homo sapiens
  misc_feature: GYAE6OF01DZJ3S.21.70.G04.1.454.CMB.1.raw
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggacgtgggttgcgagtatttttcatgatgggaccacctactataggtcgtacgctcaacagtcgagtcaccatatccgtagacacgtccaggaaccagttctccctgaagctagaactctctcgaccgccgcagaccgcgggtatatattatgtgcgagacatagtgtattggctactcgaccttagttacggtatggacgtcgtggggaccaagggaccgngacgtcaccgtcctcctcgacncctaccaccgaacggccctagtccggtaccttcccccgtcggcccgcccgtcgcctccgacggacgccacccgtccgacgcgccgaccg

SEQ ID NO: 146963 - DNA, 537 bp, Homo sapiens
  misc_feature: GYAE6OF01BN76F.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggaccgcagtcaccgtatcctcagccctccaccaacgggcccatcggtcttccccctggccgccctgcctccaggacgccacctccgagagccacagcggccctgggctcgcctggtcaaggcctacttccctcgtctctactgacgcgggctggcgaacgg

SEQ ID NO: 146964 - DNA, 601 bp, Homo sapiens
  misc_feature: GYAE6OF01D9C88.21.70.G04.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcggtatatattattgtgcgagacatagtggtattggctacncgccctattacggtatggacgtctggggccaaggggccgcaggtcaccgtctcctcagccctccaccaagggcccatcggtccttccccctcggccgccctgcctccgaggacgccaccgtcccgagacgccacacgccggcccgtcgggcctcggcccgttcgggtaccgaaacgggtacccttaaccgtttcccccgttccgttacccttccgttaaaccgttcggaacggcccggggtccgttggggccgaaaacgggg

SEQ ID NO: 146965 - DNA, 556 bp, Homo sapiens
  misc_feature: GYAE6OF01AMGC9.21.70.G04.1.454.CMB.1.raw
  modified_base (440)..(440): a, c, t, g, unknown or other
  misc_feature (440)..(440): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccaggaaggggctggagtgggttgcgagtatttttcatgatgggaccactactataggtcgtcgctcaacagtcgagtcaccatatccgtagacacgtccaggaaccagttctccctgaagctgaactctctgaccgccgcagacgcgggtaatactattattgtgacgagacatagtggtattgctactcgtcctattacggtatggacgtcgtggggcctaacgggaccnacgtcaccggtctcctcacgcctcccacgacgggccctagtccggttacctccccctcgggcccgtccccgtcgccttccgaggccgaccacccgttccgacgacgtccgaaccgg

SEQ ID NO: 146966 - DNA, 545 bp, Homo sapiens
  misc_feature: GYAE6OF01ENUDU.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtcgtggggccaaggggccgcagtcaccgtctcctcacgcctccaccaacgggccccatccggtcttccccctggccgccctcgcctcccaggacgccacctccgagacgcacacgccggcccgtgggctgccctggtcaaggacctacttccctcgtcctctactgacgcggctggcgaacgg

SEQ ID NO: 146967 - DNA, 645 bp, Homo sapiens
  misc_feature: GYAE6OF01DQLNB.21.70.G04.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagccccgagggaggggctggagtgggtgcgtagttattttcatgatgggaccactactataggtcgtcgctcaacagtcgagtcaaccatactccgtagaccacgtccaagaacctgttcctcctagaacnctagaactctctcgacccgcgcaggaccggcggtatatatttatgtgcgagactagtagtggtagttcggtactacgtccgtccttagttacgggtatgggtaccgttcggtacgggggaccaaggggtcccgacgtaacggtccctacccggttcccttccgacctaccggcccctacccgaacccggaaccgggtcccctaacgttccccgggttacccctttccccccggtgggccccgtccccgtccggtccctacccggaacgggtaccgacccgtaaccccgtcggaacggaacccgg

SEQ ID NO: 146968 - DNA, 638 bp, Homo sapiens
  misc_feature: GYAE6OF01BT1JU.21.70.G04.1.454.CMB.1.raw
  modified_base (329)..(329): a, c, t, g, unknown or other
  misc_feature (329)..(329): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccagggagggctggagtgggttgcgagttattttcatgatgggaccacctactataggtcgtcgctacaacagtcgacgtcacatatccgtagacacgtcagaaccagtctacctagaanctagaactctctcgaccgcgacagacgcggtaatactattattgtgcgagacagtagtggttattggaccttactccgtaccttaatttacggtatcggtaccgttcggtacggggacccgtaagggcccgacgtacgtcccgaacccggttcctaccccgttcgaaccggtccccctaccgaaccccgaacggggtaccccctagttccccgggttacccctttcccccggtcgggtccccgtccccgtacggtccctacccggaacggtaccgccctaccccgtaccggaacgtacgccgaacccgg

SEQ ID NO: 146969 - DNA, 540 bp, Homo sapiens
  misc_feature: GYAE6OF01AVM04.21.70.G04.1.454.CMB.1.raw
  modified_base (531)..(531): a, c, t, g, unknown or other
  misc_feature (531)..(531): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtggtattggctactcgcctattacggtatggacgtcgtggggccaagggacccgcagtcaccgtctcctcacgccctccaccacgggcccatccggtccttcccccgtcggcccgccctcgcctcccgaggacgccaccctccgacgngccgaaccg

SEQ ID NO: 146970 - DNA, 535 bp, Homo sapiens
  misc_feature: GYAE6OF01D7SI8.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgtagtattttcatgatgggaccacctactataggtcgtcgctcaacagtcgagtcaccatatccgtagacacgtccaggaccagttctccctgaagctgaactctctgaccgccgcagacgcgggtatatattattgtgcgagacatagtgtattgctactcgcctattacgtatggtacgtcgtgggccaagggccgcagtcaccgtctcctcacgcctccaccacggcccacgtccggtccttcccccgtggcccgcccgtcgcctcccgaggacgccaccctccgacgcgcaacccgg

SEQ ID NO: 146971 - DNA, 535 bp, Homo sapiens
  misc_feature: GYAE6OF01CDBWR.21.70.G04.1.454.CMB.1.raw
  modified_base (514)..(514): a, c, t, g, unknown or other
  misc_feature (514)..(514): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtggtattggctactcgccctattacggtatggacgtcgtggggccaagggaccgcgagtcaccgtctcctcacgcctccaccacgggcccagtccggtccttcccccgtggcccgccctcgcctccgaggcnccgaccctccgacgagcaccg

SEQ ID NO: 146972 - DNA, 558 bp, Homo sapiens
  misc_feature: GYAE6OF01AUK77.21.70.G04.1.454.CMB.1.raw
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttcnccctgaagctagaactctctgaccncgcagacgcgggtatatattattgtgcgagacagtagtggtattggctactcgccttattacggtatgggtacgtcgtcggggccaagggccgcgacgtcaccgtctcctcacgtccctacacccgacgggcccacgtccggtcccttcccccgtcggtcccgccccgtcgccctcccgaggacgcccacccgtccgacgcgcgaacccgg

SEQ ID NO: 146973 - DNA, 550 bp, Homo sapiens
  misc_feature: GYAE6OF01BMMPS.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtgtattggctactcgcctattacggtatggacgttcgtcggggccaagggaccgcgagtcaaccgtactccctcacgcctcccaccgaacgggcccagtccggtccttcccccgtggccgtcccctcggcctcccgacggacgccaccctcccggacgcgcaaccgg

SEQ ID NO: 146974 - DNA, 630 bp, Homo sapiens
  misc_feature: GYAE6OF01BKNYI.21.70.G04.1.454.CMB.1.raw
  modified_base (284)..(284): a, c, t, g, unknown or other
  misc_feature (284)..(284): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccagggaacggggctgggagtgggttgcgagttattttcatgatgggaccactactataggtcgtcgctcaacngtcgagtcaccatactccgtagacaccgtccacggaaccacgttcctcctagaagctacgaactcctcgtcgaccgccgacacgacggcgggtaatattagtttactgttggaccgtagaacgtattaggtaggttagttaggtcttacgttcccgtcccttaacgtttaacgggtatagggtacggttcggttcggggacccgaacggggaccggacaccggttactacccggtcttccgtcctacgtacccttccaaccgaaccggcccacttccggtcccttccccgtcggccgtcccctcgccttacccgcgacgtcccaccgtccggacagcccgtaaccg

SEQ ID NO: 146975 - DNA, 537 bp, Homo sapiens
  misc_feature: GYAE6OF01BEZXZ.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcggacccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtgtattgctactcgcctatacggtatggacgtcgtggggccaagggaccgcacgtcaccgtctcctcacgccctccaccgacggcccagtccggtccttcccccgtggcccgtccctcgcctcccgaggacgcaccctacccgacgtcgcaccg

SEQ ID NO: 146976 - DNA, 532 bp, Homo sapiens
  misc_feature: GYAE6OF01C8FJW.21.70.G04.1.454.CMB.1.raw
  modified_base (324)..(324): a, c, t, g, unknown or other
  misc_feature (324)..(324): n is a, c, g, or t
  modified_base (410)..(410): a, c, t, g, unknown or other
  misc_feature (410)..(410): n is a, c, g, or t
  modified_base (513)..(513): a, c, t, g, unknown or other
  misc_feature (513)..(513): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaaggggctggagtgggttgcgagtatttttcatgatgggaccacctactataggtcgtcgctcaacagtcgagtcacatatccgtagacacgtccaggaaccagttccncctgaagtctgaactctctgaccgccgcagacgcggtatatattatgtgcgagacagtagtgtatggctactcgcctagtacgtanggtacgtcgtgggaccaagggccacgagtctaccgtctcctcacgcctccaccacgggcccagtccggtcctccccgtcggcccgccctcgcctccgaggacnccaccctcgacgcgcaccg

SEQ ID NO: 146977 - DNA, 553 bp, Homo sapiens
  misc_feature: GYAE6OF01D0WWY.21.70.G04.1.454.CMB.1.raw
  modified_base (461)..(461): a, c, t, g, unknown or other
  misc_feature (461)..(461): n is a, c, g, or t
  modified_base (538)..(538): a, c, t, g, unknown or other
  misc_feature (538)..(538): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggcccgcaggtccacccgtctccctcacgcctccaccaacgggccccacgtccggtccttccccctggccgccctgcctcaaggacnccacctccgagacgcacagccggcccgtgggcctcgcctcggtcaaggacctaccgttcccgcgcgacgactgacgngggctggcgaacggg

SEQ ID NO: 146978 - DNA, 592 bp, Homo sapiens
  misc_feature: GYAE6OF01DGBLR.21.70.G04.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattggtgcgagacatagtggtattggctactcgccctattacggtatggacgtcgtggggccaaggggccncagtcaccggttctcctcacgccctccgaccaacgggccccagtccggtccttcccccgtgggcccgtcccctgcctccgacggacgccaccgtccggagacgccacgacggccggcccgtcggggctcggcccgttgggtaacggtaccttaccgttccctccgttctccttactacgggacggccgggtcgtcgggccgaacgggtccg

SEQ ID NO: 146979 - DNA, 616 bp, Homo sapiens
  misc_feature: GYAE6OF01BGJ1U.21.70.G04.1.454.CMB.1.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaccagttctccctgaagctgaactctctgaccgccgcagacgcgggtatatattattgtgcgagacatagtggtattggctactcgccctattacggtatggacgtcgnggggccaaggggaccncacgtcacgtctcctcacgccctccaccgaacgggccccacgttccggtccctttccccccgtcgggcccgccccgtcgcctcccgaggacgccaccctccgacgacgccacacggccggcccgtcgggcctcggcccgttacgggtccaaacgggtaccttaacccgtttccccgtacccggttcccttaccttaaccgtcggaaccgggcgggtccgtcgggcgtaaccgggg

SEQ ID NO: 146980 - DNA, 580 bp, Homo sapiens
  misc_feature: GYAE6OF01BG6SQ.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactccgccctattacggtatcggtacgtcgtcggggccaaggggccgcagtcacccgtctcctcacgcctccaccaacgggccccagtccggtccttcccccgtggcccgtcccctgcctcccgaggacgccacctccgagacgccacgacgccggcccgtcgggctcggccgtgggtaccaagggtaccttaccttcccctcgttcctccttacgtcggacggtccgggctggcgaacggg

SEQ ID NO: 146981 - DNA, 569 bp, Homo sapiens
  misc_feature: GYAE6OF01DOC7O.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaccagttctccctgaagctgaactctctgaccgccgcagacgcgggtatatattattgtgcgagacatagtgtattgctactcgcctagttacgtatggacgtcgtcggggccgaagggaccgcgagtcacccgtcgtcctcacgccctcccacccgacgggccctacgtccggtccttccccccgtcggtcccggtccccttcggccttaccccgagggaccgcccgtaccccgtcccggacgacgccgaacccgg

SEQ ID NO: 146982 - DNA, 565 bp, Homo sapiens
  misc_feature: GYAE6OF01C4ZTU.21.70.G04.1.454.CMB.1.raw
  modified_base (383)..(383): a, c, t, g, unknown or other
  misc_feature (383)..(383): n is a, c, g, or t
  modified_base (447)..(447): a, c, t, g, unknown or other
  misc_feature (447)..(447): n is a, c, g, or t
  modified_base (472)..(472): a, c, t, g, unknown or other
  misc_feature (472)..(472): n is a, c, g, or t
  modified_base (513)..(513): a, c, t, g, unknown or other
  misc_feature (513)..(513): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccagggaacggggctggagtgggttgcgagttatttttcatgatgggacctacctactataggtcgtcgctcaacagtcgagtcaccatactccgtagacacgtccaggaacctagttcctccctgaagtctagaactctctcgaccgcgcagacgcgggtatatattatgtgngagactatagtgtattgctactcgcctattacggtatggacgtcgtcggggaccaagggaccgngtacgtccaaccgtcctcctcgacnccctaccaaccgacgggccctacgtccggtcccttccccgnggtcccgcccttcgcctccgaaggacgcctaaccgtccgaacgtcgcaccgg

SEQ ID NO: 146983 - DNA, 534 bp, Homo sapiens
  misc_feature: GYAE6OF01ED6YC.21.70.G04.1.454.CMB.1.raw
tcagtcgtcgctcgcacgaccggtgctcgatttagtgtagtgtgaagggaaagggtctccgaaggcttcaccagtcctgtcccagctgcagctacaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctgggccaagggaccgcagtcaccgtctcctcagcctccaccaacgggcccagtccggtccttccccctggccgccctgcctcccgaggacgccacctccgagacgcacgacgg

SEQ ID NO: 146984 - DNA, 547 bp, Homo sapiens
  misc_feature: GYAE6OF01DTP0B.21.70.G04.1.454.CMB.1.raw
  modified_base (380)..(380): a, c, t, g, unknown or other
  misc_feature (380)..(380): n is a, c, g, or t
  modified_base (538)..(538): a, c, t, g, unknown or other
  misc_feature (538)..(538): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggccncagtcaccgtctcctcacgcctccaccaacgggccccatccggtccttcccccgtggccgccctgcctccgacggacgccaccctccgagacgcacacgccggcccgtgggctcggcctggtcaaggacctacttccctcgtctctactgacgcggcnggcgaacgg

SEQ ID NO: 146985 - DNA, 628 bp, Homo sapiens
  misc_feature: GYAE6OF01A6HBF.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtcgtggggccaaggggacccgcacggtccacccggttctccctccacgccctccgacccaacgggccccacgtccggtccttcccccgtcggcccgtcccgtcgcctcccgacggacgccacctccgacgacgccaccgacggcccggcccgtcggggcctcggcccgttgggtaccgaacgggtacccgttaccgtttcccccggaacggcccggaccggtaaccgttcgggacggtcccgggggtcgtccgggcgtaaacgggg

SEQ ID NO: 146986 - DNA, 588 bp, Homo sapiens
  misc_feature: GYAE6OF01ARYDW.21.70.G04.1.454.CMB.1.raw
  modified_base (375)..(375): a, c, t, g, unknown or other
  misc_feature (375)..(375): n is a, c, g, or t
  modified_base (445)..(445): a, c, t, g, unknown or other
  misc_feature (445)..(445): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtggttgcgagtattttcatgatgggaccacctactataggtcgtcgctcaacagtcgagtcaccatatccgtagacacgtccaggaaccagttctccctgaagcctgaactctctgaccgccgcagacgcgggtatatattattgtgcgagacatagtggtattggctactcgccctatacggtatggactcgtgggccaagggccnagtcaccgtctcctcacgcctccaccaagggcccatccggtcttccccctgccgccctgcctccaggacnccaccctccgagacgcacgagccggacccgtgggccgtcggacccttcgggtccgaaacgggtacccttaaccgtttcccccgttcgttcccttacccttaccgtcggtacggcccggggccttcggggcccgtaaaccgggg

SEQ ID NO: 146987 - DNA, 600 bp, Homo sapiens
  misc_feature: GYAE6OF01CHPK8.21.70.G04.1.454.CMB.1.raw
  modified_base (278)..(278): a, c, t, g, unknown or other
  misc_feature (278)..(278): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggctggagtgggtgcgagtattttcatgatggaccactactataggtctcgctcaacngtcgagtcaccatatccgtagacacgtccaggaacctagttcctccctagaacgtctacgaactctctcgaccgccgacagacgcggtatattattagttgtagcgagactagtagtggtattcggacttaaccgtccgtacccgttagttacggtagtacgggtacgttcggtacgggggaccaacggggaccgcgtaacgtccaccggtcctccgtcacgtccctacccgaccgacgggcccagttcccgtcccttccccgtcggcccgtcccgtcgccctaccgacgacgacccacccgtaccgaacgcgcctaaccgg

SEQ ID NO: 146988 - DNA, 550 bp, Homo sapiens
  misc_feature: GYAE6OF01B372N.21.70.G04.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (504)..(504): a, c, t, g, unknown or other
  misc_feature (504)..(504): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccagcccccgagggaaggggctggagtgggttgcgagtatttttcatgatgggaccaccgtactataggtcgtcgctcaacagtcgagtcaccatatccgtanacacgtccaggaaccagttctccctgaanctgaacctctctgacccgccgcaacgacggcggtactaattacttattgtgcgagactatagtgtatggctactcgcctatacgtatggacgtcgtgggccgaagggaccgagacgtcaccgtctcctcacgcctaccgaccaacgggcccagtccggtccttcccccgnggtcccgccctcgcctcccgaggacgccacccgtccgagcgcaccg

SEQ ID NO: 146989 - DNA, 572 bp, Homo sapiens
  misc_feature: GYAE6OF01EGU3W.21.70.G04.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggctggagtgggttgcgtagttattttcatgagtgggaccacctactataggtcgtcgctcaacagtcgagtcaccatatccgtagacaccgtccaaggaacctagttcctaccctgaacgctagaactctctcgaccgccgcagacgcggtatatattatgtgcganactatagtgtattcggctacgtcgtcctagttacggtagtcgggtacgtcgtcggggaccaaggggacccgcgacgtccgtacccgtcttccctcgacgtccctaccaccgaacgggcccagtccgttcccttccccgtcggcccgtccctcgcctacccgagcgccaccgtccgagcgcgacg

SEQ ID NO: 146990 - DNA, 597 bp, Homo sapiens
  misc_feature: GYAE6OF01D6SH8.21.70.G04.1.454.CMB.1.raw
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
  modified_base (461)..(461): a, c, t, g, unknown or other
  misc_feature (461)..(461): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttattttcatgatgggaccacctactataggtcgtcgctcaacagtcgagtcaccatatccgtagacacgtccagaaccagttctccctgaagctgaactctctgaccgccgcagacgcgggtatatattattgngcgagactatagtggtattggctactcgccctattacggtatggacgtcgtggggccaaaggggcccncgagtccaaccgtctccctacacgccctcccgaccaaacggggcccctaagtccggttcccttccccccgtgggcccncccgtcgcctccgacggacgccacctccgagacgccacgagcccggcccgtgggcctcgccgtcggtaccaacgggtacctacccgttcccggaacggccgtaaccgacgtcggacgccgggctcgggcgaacggg

SEQ ID NO: 146991 - DNA, 608 bp, Homo sapiens
  misc_feature: GYAE6OF01C58FT.21.70.G04.1.454.CMB.1.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcactggggctggatccgccagcccccagggaagggctggagtgggtcggccgtattacaaggaaagctaacagttacagtacagaatacggcgcgtctgtgaaaggaaggttcaccatctcaagagatgattcaaaagaactcactgtaatctgacaaatgaaacagcctagaaaaccgngacacggctgtattatgtgtagaacaaaagngtggatgtggtgtagctgtgacatgatgctctgatatcgtggggaccaggggactaagtcgggtaccaccgttctaccttcgaccgccctacccgaaccgtaacggggcccctaagttcccgggttcccctttccccgtacgggcccgtcccctcggccctacccgaaggaccgtccctaacccgtcccggaagcggaccacgacggcccggccggtgggcctcggccgtacggtacaacgggtaccttacccgttccctccgtctacccg

SEQ ID NO: 146992 - DNA, 529 bp, Homo sapiens
  misc_feature: GYAE6OF01D1OEC.21.70.G04.1.454.CMB.1.raw
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
  modified_base (438)..(438): a, c, t, g, unknown or other
  misc_feature (438)..(438): n is a, c, g, or t
  modified_base (453)..(453): a, c, t, g, unknown or other
  misc_feature (453)..(453): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggatccgccacgccccgagggaaggggctggagtgggttgcgagttattttcatgatgggaccacctactataggtcgtcgctcaacagtcgagtcaccatacnccgtagacacgtccaaggaacctagtctccctgaagctagaactctactgaccgccgcagacgcggtatatattatgtgcganacatagtgtatggctactcgcctagttacggtatggacgtcgtgggccaagggccnacgtcaccgtctccncacgcctccacacggcccagtccgtcctccccgtggcctcccngtccnccgagcgccaccgtacgacgcgcgaccg

SEQ ID NO: 146993 - DNA, 847 bp, Homo sapiens
  misc_feature: GYAE6OF01CQRFH.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtgctccatcatcaatggtcattatcactggggctggatccgccagcccccagggaagggctggagtgggttgcgagtattttcatgatgggaccacctactataggtcgtcgctcaacagtcgagtcaccatactccgtagacaccgtccgacggaacctagttcctcccgtagaacgtctacgaaccttcctctacgaccccggccgacgaacggaccggtacggggttaattaattatttagttggtcgacgaagactaagttaggttggttagtcggaccttaccgtccgtacccttaagttaccggtagttcggacgtcggtcggggaccgtaaacggggcccgacgacgtccgtaacccggtccttccctaccgaccgtcccctaccccgaacccggaaaccgggtaccccctaacgttcccgggttcccctttacccccccggtcgggtcccccgttcccccgttacggccccttaccccggaacgggtacccgaccccgtaaccccggttaccccggaacggtaacccggacccgaaccgggtaaccgggacccccggggtaccccgggttcgggggtacccttccggggtaccccgttacggggttaacccgaaaaccggggttacccctttaccccgttttacccccggttacccggtttacccgtttacccgttaacccggttacgggaaccggggtcccgggggtaccgttcggggaacccggtaaacccgggg

SEQ ID NO: 146994 - DNA, 673 bp, Homo sapiens
  misc_feature: GYAE6OF01EG1PQ.21.70.G04.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagtgtagtgtgaagggaaagggtcgtccgaaggcttcaccagtcctgtcccagctgcagcctgcaggagtcggcccaggactggtgaagccttcggagaccctgtccctcacctgcactgtctctggtggctccatcatcaatcggtcattatcacgtggggctggactccgccacgcccccgagggaacggggcgtgggagtgggttgcgtagttnttttcatgacgtcgggacctacgtactagtacggtcgtcgctcgaactaggtcgacgtccacctatactccgtagaccgacgtccgaaggaacctggttccctccgtagaacgccgtacgaacctctcgtcggaccgtccgacgacggacggtcgggttaattacttacgttagtcgtgaccggaagtacgtagttaggttggtacttgggtacttaccgtccgtacctagtttacggtagtcggtacgttcggtacgggaccgaacgggtccgtacgtacgtccgtaccgttcctcccgtacgtaccgtccctaccgaaccggaacggtcccgtacgtccggttccccttccccgtagggtcccgtcccgtcgtccgacccgacggactcccgtacccgtaccgacgtccgccgtaacccgg

SEQ ID NO: 146995 - DNA, 658 bp, Homo sapiens
  misc_feature: GYAE6OF01AFRPU.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccgaggggaacggggctgggagtgggttgcggtagttatttttcatgagtcgggaccacctactataggtcgtcgctacaacagtcgagtcaccatatccgtagaccacgtccgacggaaccagttcctccctagaacgtctacgaactcctctacgacccgccgcgacggacggacgggtatattattattgtcgacgtagactagttagtggtagttggtctacgtcgtcctagttacggtagtgggacgtcggtcgggaccgaacgggccgacgacgtaccgtacccgtcctaccctccgaccgtccctacccgaacccgaaccgggtcccctacggttcccggttacccccttccccccggtacggtcccccggtccccgttccggcccgtaccccggaggtacccgacccgacccgttacccggacgaccgtccaaacccggg

SEQ ID NO: 146996 - DNA, 630 bp, Homo sapiens
  misc_feature: GYAE6OF01DPVDA.21.70.G04.1.454.CMB.1.raw
  modified_base (224)..(224): a, c, t, g, unknown or other
  misc_feature (224)..(224): n is a, c, g, or t
  modified_base (383)..(383): a, c, t, g, unknown or other
  misc_feature (383)..(383): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacngtcgagtcaccatatccgtagacacgtccaggaccagttctccctgaagctgaactctctgaccgcgcagacgcggtatatattattgtgcgagactatagtggtattggctactcgacccttagttacggtatggacgtcgtggggaccaaggggccncagtccaccgtctcctcacgccctaccgaccgaacgggcccctagtccggttcccttccccccgtcggcccgccccgtcgccgtcccgagggaccgccacccgtacccggagaacgccaaccgacggcccggtccccgtgggtccgtcgtcccgtcgggtaccgtaacgggtacccttaaccgtttccccgttcgttcccttccgtaaccgtcgggaacggccggggtacgtcgggacgtaaacggg

SEQ ID NO: 146997 - DNA, 548 bp, Homo sapiens
  misc_feature: GYAE6OF01AUSOS.21.70.G04.1.454.CMB.1.raw
  modified_base (518)..(518): a, c, t, g, unknown or other
  misc_feature (518)..(518): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggaccgcacgtcaccgtctcctcacgccctccaccaacgggccccagtccggtccttcccccgtcggccgcccctgcctccgaggcgccacctccgagacgcacgagccggccctcggctgcctggtcaggcctacttcccgngccgacgactgacgcgggctgggcaacggg

SEQ ID NO: 146998 - DNA, 531 bp, Homo sapiens
  misc_feature: GYAE6OF01BK46T.21.70.G04.1.454.CMB.1.raw
  modified_base (377)..(377): a, c, t, g, unknown or other
  misc_feature (377)..(377): n is a, c, g, or t
  modified_base (459)..(459): a, c, t, g, unknown or other
  misc_feature (459)..(459): n is a, c, g, or t
  modified_base (518)..(518): a, c, t, g, unknown or other
  misc_feature (518)..(518): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagccccagggaaggggctggagtgggttgcgagttatttttcatgatgggaccacctactataggtcgtcgctcaacagtcgagtcaccatactccgtagacacgtccaggaaccagttctccctgaagctgaactctctgaccgccgcagacgcgggtatatattattgtgcgagacatagtgtattggctactcgcctatacggatggctcgtggggccaagggaccgnagtccaccgtctctcagcctccaccacggcccactcggtcctccccctggccgccctcgcctccgaggcgccacctccgacncgcacgacgccggccgtggctgcctggtcaacggctacttccctctctctacgtgacgnggcgtggcgacgg

SEQ ID NO: 146999 - DNA, 592 bp, Homo sapiens
  misc_feature: GYAE6OF01A92IL.21.70.G04.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtcgtggggccaaggggccncgagtccaccgtctcctcacgccctccgaccgaacgggcccctacgtccggtcccttcccccgtcggcccgtccctcgcctccgacggacgccaccgtccgacgacgccacgacgccggcccgtgggcctcggccgtcggtaccgaacggtaccttacccttccccgtccgttccttcgtacgtcggacggccgggcgtcgggcgaacggg

SEQ ID NO: 147000 - DNA, 593 bp, Homo sapiens
  misc_feature: GYAE6OF01BOYMW.21.70.G04.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagccccagggaggggctggagtgggttgcgagtatttttcatgatgggaccacctactataggtcgtcgctcaacagtcgagtcaccatatccgtagacacgtccaggaaccagttcncctgaagctgaactctctgaccgccgcagacgcgggtatatatttattgtgcgagactatagtggtattggctagtcacctagttacgtatggacgtcgtcggggccaagggaccgcacggtcacccggtctacccgtccacgtccctacccgaacccaacgggccccaagttcccggttacccttaccccccgttcgggccccgtccccgttcgcccgtcccgtaccgggacgacccgtaccccgtaccggaaccgacggtccgaacccgg

SEQ ID NO: 147001 - DNA, 788 bp, Homo sapiens
  misc_feature: GYAE6OF01CICZS.21.70.G04.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccacgcccccagggaaggggctgggagtgggttgcgagtattttcatgatgggaccactactataggtcgtcgctacaacagtcgagtcacatatccgtagacacgtccaggaaccagttcctccctagaacgctagaacctctctcgaccgccgcaggacgcggttatattattattgtgacgtanactataggtggtattcggactactccgtacccttaagttaccgggtaatcgggaaccggttcgtacggggggacccaaagggggaccccgactaacggttcccgaaacccggtttcctacccgttaccgacggtccccttacccgaaaccccgaaccggggtaccccctaacgtttacccgggttccccttttccccccggtacgggtccccggtccccccgttcggtaccccgttacccggaacgggtaaccgacccgtaaccccgttacccggaaggaccgacccgaaccgtaaccgggcccgggaccccggttcggggtcccgtacgggtccccgttacgggtaacccgtaaaccggtacccgtttaacccgtttaccccccgttaccgtttacccgttacccttaaccggtacggaacgggacccggggtcgtaccgggacccgtaaaccggg

SEQ ID NO: 147002 - DNA, 636 bp, Homo sapiens
  misc_feature: GYAE6OF01C4YVD.21.70.G04.1.454.CMB.1.raw
  modified_base (392)..(392): a, c, t, g, unknown or other
  misc_feature (392)..(392): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccgagggaaggggctgggaggtgggttgcgtagttattttcatgatcgggacctacctactataggtcgtcgctcaacagtcgagtcaccatatccgtagcacgtccaaggacctagttcctccctgaacgctagaactctactgacccgccgacaggaccgcgggtaatattatttattgngtacgagactagtagtggtattggacttacgtcgtccttaagttacggtatcgggtacgtcggtacggggaccgaacgggggtacccacggtacgtaccgtaacccgttccttacccgtcgaccgcccttacccgaacccgaacggggacccctagttcccggttccccttcccccgtcggtcccgtccccgtcgtccctacccgacggacgtacccacccgtccggaacgccgacgtacccgg

SEQ ID NO: 147003 - DNA, 554 bp, Homo sapiens
  misc_feature: GYAE6OF01C0UDX.21.70.G04.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (380)..(380): a, c, t, g, unknown or other
  misc_feature (380)..(380): n is a, c, g, or t
  modified_base (438)..(438): a, c, t, g, unknown or other
  misc_feature (438)..(438): n is a, c, g, or t
  modified_base (479)..(479): a, c, t, g, unknown or other
  misc_feature (479)..(479): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctggagtgggttgcgagttattttcatgatgggaccacctactataggtcgtcgctcaacngtcgagtccaccatanccgtagacacgtccaggaaccagttctccctgaagctagaactctctgaccgccgcagcgcgggtatagtattatgtgcgagacatagtggtatggctactcgcctattacggtatggacgtcgtgggccaaggggccncagtcaccgtctccgtcacgccctaccaccgaacgggcccagtcgtcctcccctggcnccctgctccgagcgccactccgagacgcacgagccggccgngggcctcgcctcgggtcaacggccctacgttcccgaaggtccgaacgactcggacggccgggcgtggcgaacggg

SEQ ID NO: 147004 - DNA, 493 bp, Homo sapiens
  misc_feature: GYAE6OF01BXP9F.21.70.G04.1.454.CMB.1.raw
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttcctcctgaagctgaactctctgaccgccgcagacgcggtatatatattgngcgagacatagtgtattggctactcgcctatacggtnggactcgtgggcaagggccncagtcaccgtcncctncgcctcaccaggcccatcgtctcccngcnccncgcnccngncncnccgangcacngcgcctggctgcctggcagctactccctntcctctcngacgcggctggcgacg

SEQ ID NO: 147005 - DNA, 754 bp, Homo sapiens
  misc_feature: GYAE6OF01CRU3Z.21.70.G04.1.454.CMB.1.raw
  modified_base (293)..(293): a, c, t, g, unknown or other
  misc_feature (293)..(293): n is a, c, g, or t
tcagtcgtcgctcgcacgaccggtgctcgatttagtgtagtgtgaagggaaagggtctccgaaggcttcaccagtcctgtcccagctgcagctgcaggagtcggcccaggactggtgaagccttcggagaccctgtccctcacctgcactgtctctggtgctccatcatcaatggtctattatcacgtgggctggactccgccacgccccgaagggaggggctggaggtggttgacgtagttatttttcatgtagtcgggacctactactaagtcggtcgtcgactacaacgngtcgacgtcaacctatactaccgtagactacgtaccgaacggtaacctagttcctaccctagaacgtcgtacgaacctctccgtcgacccgccgacgacggacggtacggtaattaacgtttaatttagttcggtaggaccgtaagtaacgtagttaacgggtttggttaacgttcgggtaaccttaccggtttaccccgtacccgtttaaggtttaccggttaagtcgggtaccggttccggtacggggacccggtaaaggggacccgacgtacggtcccgaacccggttccctacccgtccgtacccgtccccgtaacccgaacccgtaccgggacccctcggtttaccccgggttcccccttcccccgggtcggtcccccggtcccttccggccccgtaccgtaaccgggacctacccccggacccgttacccggaaacgcccgtacccgtaaccggg

SEQ ID NO: 147006 - DNA, 593 bp, Homo sapiens
  misc_feature: GYAE6OF01CBWPG.21.70.G04.1.454.CMB.1.raw
  modified_base (391)..(391): a, c, t, g, unknown or other
  misc_feature (391)..(391): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatactccgtagacacgtaccaggaaccagttctccctgaagctgaactctctcgaccgccgcagacgcgggtatatattattgtgcgagactatagtggtattggctacgtcgccctaagttacggtatcggacgtcgtggggaccaaggggaccncgagtccacccgtctcctcacgccctccaaccgaacgggcccccaagttcccggttccctttccccccgcggtcccgccccgttcgccgtccgacggacgccaccgtccggacgacgccacgagccggccgtggcctcgccgtggtcgaaggccttaccttccctcgtccttctaccgtcgacggcggtcgtggcgaacggg

SEQ ID NO: 147007 - DNA, 647 bp, Homo sapiens
  misc_feature: GYAE6OF01CT1TX.21.70.G04.1.454.CMB.1.raw
  modified_base (296)..(296): a, c, t, g, unknown or other
  misc_feature (296)..(296): n is a, c, g, or t
  modified_base (624)..(624): a, c, t, g, unknown or other
  misc_feature (624)..(624): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtgctccatcatcaatggtcattatcacgtggggctggactccgccacgccccgaagggacggggctggagtgggttgcgtagttattttcatgatcgggaccactactagtcggtacgtcgctacaacgngtcgagtcaacctatagtccgtagaccacgtccaaggaacctagttctaccctgaagctgaacctctctacgaccgccgacacggcgcggtaatattattaagttggtcgacgtagtactaagttaggtaggttattcggacttacgtccgtaccttagttaaccggtagtacggtacgtcgtacggggaccgaagggacccgtcgacgtccgtacccgttcctaccctccgacgacccttcccgaacccgtaaccgggacccctacgttcccgggtcccttaccccccggtgggcccctcccgtccgtcccgtaccgaccgggtacncccgtacccgtccgacggacccg

SEQ ID NO: 147008 - DNA, 583 bp, Homo sapiens
  misc_feature: GYAE6OF01EXH3Q.21.70.G04.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccgagggaaggggctgggaggtgggttgcgtagttatttttcatgatgggaccactactataggtcgtcgctcaacagtcgagtcaccatatccgtagacacgtccaggaaccagttctccctgaagctagaactctctcgaccgccgcacgacgcgggtatactattatgtncgagacatagtgtatggtctactcgcctattacgtatcggtacgtcgtcgggcgaacgggaccgcgacgtcgacccgtctccctcgacgccctaccaccgaacggcccacgtccggttacccttccccccgtcgggcccgtccccgtacggcccttacccgacgggtacgtcccacccgtacccggacgcgccgaaccgg

SEQ ID NO: 147009 - DNA, 718 bp, Homo sapiens
  misc_feature: GYAE6OF01D7GRH.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtctattatcacgtgggctggactccgccacgccccgagggaacgggctggagtggtgcgtagttattttcatgagtcggacctacctatagtaggtcgtcgctacaacagtcgacgtcaacctatacgtccgtacgacctaccgtacccaacggaacctacgtttccctacccgtaggaaacgtccgttaacgtaaccttccgtaccgtaccggaccccgccgacgaacggtaccgggtacgggttaaattaacgttaattttagtcggttaggaaccgtaagaacgttaaggttacggttagggtttacgttacgggtacctttaccgttacccgttacccttaacggtttacggtagttcgggtaaccgttcggtacggggaccgaacgggtccgacgtaccgtccgtacccggtcctacccgtcaccgtccctaccgaacccgacggtcccacggttcccgttcccgtcccccggtggtccctcccgtaccgtccacccgacggacgtccccacccggtacgacgtccgccgtaaccgg

SEQ ID NO: 147010 - DNA, 712 bp, Homo sapiens
  misc_feature: GYAE6OF01CVM67.21.70.G04.1.454.CMB.1.raw
  modified_base (701)..(701): a, c, t, g, unknown or other
  misc_feature (701)..(701): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctcatcatcaatggtcattatcacgtgggctaggactccgccacgccccgaagggaacgggcgtggaggtgggtgcgtagttatttttcagtgagtcggacctactactagtaggtcgtcgctacaacgagtcgagtaccactatacgtaccgtaagacctaccggtaccgaacggtaaccctacgttcctaccccgtaaggaaccgtctaacggtaaccctcgtaccgtaccgaacccgccgtacgaacggaccggtaacggttaactaaaggtttatttaacgtttggtacggaacgtaacgaacgtacgttaaggttaggtttagttcggtacttaccgttcccgtacccgtttaagttaaccggttagtaccggtacggttcggtacgggtaccggaaccgggaccgtacgacgtaccgtaaccgttcctaccgtcgaccgcccacccgtaaccgaccggcccgtaaccgtccgttcccgttccccgtacggtccgtccccgtcgcctaccgaccgacgaccctacgaccggacncgtccaaccgg

SEQ ID NO: 147011 - DNA, 525 bp, Homo sapiens
  misc_feature: GYAE6OF01C5RLT.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccaccagccccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgccctattacggtatggacgtctggggccaagggccgcagtcaccgtctcctcagcctccaccaagggcccatcggtcttcccctggcgccctgctccaggacgcacctccgagagcacagcggccctgggctgcctggtcaaggctacttccctcgtcctctactgagcgggctggcaacgg

SEQ ID NO: 147012 - DNA, 781 bp, Homo sapiens
  misc_feature: GYAE6OF01D0O5U.21.70.G04.1.454.CMB.1.raw
  modified_base (244)..(244): a, c, t, g, unknown or other
  misc_feature (244)..(244): n is a, c, g, or t
  modified_base (376)..(376): a, c, t, g, unknown or other
  misc_feature (376)..(376): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatacaatggtcattatcacgtgggctgactccgccgacgccccgaggggagggcgtggaggtgggtgcgtagttnttttcagtgagtcggacctaccgtatagtaggtcgtcgtctacaactacgtacgacgtccaactactactcgtagaccaccgtaccaaggaacctacgttacctaccgtagaacgtaccgtagaacccttcnccgtacggacccgaccggacgaacggaccggtacgggttaattagttaagtttagtcggtaggacgagtaacgtaagttaggttaggttattcggtaccgttacccgtaccgttaccccgtttaaggtttacggttaacggttcgggtaacggttccggtaacgggggtaacccgtaaccggggtacccgtacggaacgttcccgtaaccgttccttacccgaccgtaaccttccccgtaacccgaacccggacccggggtaccctacccggttacccggtttccccctacccccgggttccggtccccggtacccctaccgggtaccccttaccccgggaaccggacccgttaccccgaaccccggttacccgggaaaccgggaaccgccccggtaaacccggg

SEQ ID NO: 147013 - DNA, 583 bp, Homo sapiens
  misc_feature: GYAE6OF01D062X.21.70.G04.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagcccccgagggaaggggctggagtgggtgcgagtattttcatgatggaccactactataggtcgtcgctcaacagtcgagtcacctatatccgtagacacgtccaggaaccagttcncctgaagctgaactctctgaccgccgcagacgcggtatatattattgtgacgagacatagtggtattggtctactcgtacctattacggtagtcggacgttgtcggggacgaacgggaccgcgaacgtccgacccgtcctcccgtacaccgtccctccaaccgaaccggcccctacgtccggtcccttcccccgtggtccccgtcccctcggccctacccgacggtaaccgcccgaacccgtccggaaggtaccg

SEQ ID NO: 147014 - DNA, 543 bp, Homo sapiens
  misc_feature: GYAE6OF01A3JAZ.21.70.G04.1.454.CMB.1.raw
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
  modified_base (465)..(465): a, c, t, g, unknown or other
  misc_feature (465)..(465): n is a, c, g, or t
  modified_base (526)..(526): a, c, t, g, unknown or other
  misc_feature (526)..(526): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggatccgccacgcccccagggaaggggcgtggagtgggttgcgtagtatttttcatgatgggaccacctactataggtcgtcgctcaacagtcgagtcaccatactccgtanacacgtccgaggaccagttctaccctgaacgctagaactctctcgaccncgcagacgcggtatagattatgtgcgaagactagtagtcggtattggctactcgaccctagttacgtatcgggtacgtcgtgggacaacgggcgcgacgtcaccgttcncctcacgccctacaccgaaggcccagtccgtccttccctcggccgccctgctcccaggacnccactacgcgacgcacg

SEQ ID NO: 147015 - DNA, 602 bp, Homo sapiens
  misc_feature: GYAE6OF01C8KTI.21.70.G04.1.454.CMB.1.raw
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttattttcatgatgggaccacctactataggtcgtcgctcaacagtcgagtcaccatatccgtagacacgtccaggaaccagttctccctgaagctgaactctctgaccgcgcagacgcggtatatattatgtgcgagacatagtggtattggctactccgcccttattacggtatggacgtcgtggggccaagggccgnacgtcaccgtctcctcacgccctaccaccgaacgggcccagtccggtcccttcccccgtggccgcccctcgcctccgacggacnccaccgtaccgagacgacncgacggcccggtcccgtgggccgtacggcccgtagggtaccgaacggtacccgttacctttaccccggtccgttacctcccttacgtcggacgggccgggaccgtgggacggtaacggg

SEQ ID NO: 147016 - DNA, 569 bp, Homo sapiens
  misc_feature: GYAE6OF01EMPQ6.21.70.G04.1.454.CMB.1.raw
  modified_base (448)..(448): a, c, t, g, unknown or other
  misc_feature (448)..(448): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggctggagtgggttgcgtagttattttcatgatggaccactactataggtcgtcgcttcaacagtcgagtcaaccatatccgtagacacgtccaggaaccagttcctaccctgaagctagaactctctcgaccgcgcaggacgcgggtaatatattatgtgcgagacatagtgtattggctactcgtcctagttacgtatggacgtgtcgggcgaacggccgcagtcnccgtctcctcgacgcctacccaccgaacggcccgtatccggttcccttacccccgtcggtcccgtcccgtcgtcccgtaccgacggtacgcccacccgttaccgacggtaccgcaacccgg

SEQ ID NO: 147017 - DNA, 878 bp, Homo sapiens
  misc_feature: GYAE6OF01B8FDY.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatgtcattatcacgtggggctggactccgccacgccccgaggggaaggggctgggaggtgggttgcgtagtttattttcagtgagtcggaccacctatagtaggtcgtcgctacaacagtcgagtcaccatactccgtagacacgtccaggaacctagttcctccgtagaacgtctagaacctctctacggacccgccgacgtaacggacggtacgggttaattaattattttaagttcggttacggaccggtaacgtaaccgttaagttaagggtttagggttaacgtttcggggtacctttaccggttacccgttaccccgtttaaaggttttaccgggttaacggttcgggtaaacccgggtttccgggtaccgggggggtaacccgtaaacggggggtaccccgtaccggtaaccgggttacccgtaaccccgggtttccccttacccggttacccgaaccccggttcccccgtaaccccgtaacccccgggaacccggggtaccccccgttaaccgggtttccccccggggttttaccccccggttttaccccccccgggttaccgggggtcccccccggttcccccggtttacccggtcccccggtttaaccccggaaaccggggtaccccggtaaccccggttaacccccgttaaccccggggaaccggttaacccgggaccccggtaaaccccgggg

SEQ ID NO: 147018 - DNA, 787 bp, Homo sapiens
  misc_feature: GYAE6OF01C9URM.21.70.G04.1.454.CMB.1.raw
  modified_base (288)..(288): a, c, t, g, unknown or other
  misc_feature (288)..(288): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtcggctccatcatcaatggtctattatcacgtggggctggactccgccacggccccgaggggacggggctggagtgggtgcgtagtttattttcgatgagtcggacctacctacttagtacggtcgtcncttacaacgtgtacgagtcaacgtataaccgtccgtaacgacctaccgtaccgaaacggtacctacgttcccaccgtaggtaacgtctaacggaaccttcgtctccggaccncccggtanaccggtaccggacggtaatacgttaatttaggttgtacgacggtaaagtacgtagttaagttagggttacgtttcgggaccttaccgttacccgtacccgttaagtttaacggtaggttacccgggtaacggttccggggacggggtacccggtaaaccggggaccctacgaaccgggtttacccgtaccccgtccgtttaccccgaaccgtaccctacccccggttacccaaaccccgggtaccgggtaccccgttaacccggttcccgggttacccccccttcccccgggacgggtcccccgtaccccggtacgtcccgtaaccccggaccgggactcccccgttaaccgaccggacgtaccggccctaacccgggg

SEQ ID NO: 147019 - DNA, 869 bp, Homo sapiens
  misc_feature: GYAE6OF01BWOR4.21.70.G04.1.454.CMB.1.raw
  modified_base (172)..(172): a, c, t, g, unknown or other
  misc_feature (172)..(172): n is a, c, g, or t
  modified_base (564)..(564): a, c, t, g, unknown or other
  misc_feature (564)..(564): n is a, c, g, or t
  modified_base (859)..(859): a, c, t, g, unknown or other
  misc_feature (859)..(859): n is a, c, g, or t
tcagtcgtcgctcgcacgaccggtgctcgatttagtgtagtgtgaagggaaagggtctccgaaggcttcaccagtcctgtccagctgcagctgcaggagtcggcccaggactggtgagccttcggagaccctgtccctcacctgcactgtctctggtcgctcctatcaagtntaagtggtacattatcgacgtgggctggactccgaccgacgccccgaaggggacgggctcggggtagtcgggttacgacggtaacgtttaatttttcgagtacggtacgtacgggaacctaaccgttacgttaacgttacggtccgttaccgggtacttaaccgtaaacgtacgggttaccgtacggtttaccgaaccgtaagttaccgttaaccggggttaactaaccgaccggtttaacccggaacgggttaacccttacgggtttacccgtaccccggttaaggtaaccgtaccggtaacgttaaccgttcgtaccggttacggaccggtaccgaacggtaacgaaccggggtttcgtaaacgttaattacggttaacgttcgggtacncgggtaaacttagtttaacgggttaggttaccgggttaacgtttcggggtacctttaccgggttacccgtaccgttaacggttaaccggtgtttaccgggtaccggtccggttaacgggaccgaacggtccggcctaccgttaacgcccgttatacccgcgttaaccgtacctacccgtacggtaccggtacccttacggttaccgtccccgttaccccgggtggcccgttaccgttacccggccgttacggtaaccggtacgttccccaacggttaccggacggtaaaccccgngtaacccggg

SEQ ID NO: 147020 - DNA, 697 bp, Homo sapiens
  misc_feature: GYAE6OF01EGZ0M.21.70.G04.1.454.CMB.1.raw
tcagtcgtcgctcgcacgaccggtgctcgatttagtgtagtgtgaagggaaagggtctccgaaggcttcaccagtcctgtcacagctgcagctgcaggagtcgggcccaggactggtgagccttcggagaccctgtccctcacctgcactgtctctggtgctccatcatcaatggtcattatcacgtggggctggactccgcccacgcccccgagggaacggggctgggagtgggttgcgtagttatttttcatgagtcgggacctacctactagtaggtcgtcgctacaacagtcgagtcaccatatccgtagacacggtaccaacggaacctagtttcctacccgtagaacgtctacgaaactctcgtacgacccgccgacaggaccgacggttatacgttattagttgtgacgagactagtaggttagtagtggtacttactccgtaccttagttaccggttagtcgggtaaccgttcgggtacggggacccggtaacggggacccacgtaaccggtcccgtacccggttccctccccgtaccgaaccgtccccttaccccgaacccggaacccgggtcccctaaccggttcccggttcccccgtttaccccccggtcgggtcccccgttaccccttcggtaccccgccgtaaccgggacctacccgaaccccgtaccggacgacggaaccccg

SEQ ID NO: 147021 - DNA, 733 bp, Homo sapiens
  misc_feature: GYAE6OF01BSZF6.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctcgtggtgctccatcatcaatggtcattatcacgtgggctggactccgccacgaccccgaggggaacgggcgtggaggtgggttgacgtagttattttcagtgagtacggaacctaccgtacgtagtacggtcgtcgactacaacgagtcgacgtaccaactaacgtactaccgtaagacctaccgtaccgaacggaacctaacggttccctacccgtaggaaccgtacgtacgaacctcgttccgtacggaccgaccgacgaacgacgggtacggtaataagttactttagtcgtagaccgtaagacgtaagtagtggttagtcggtactacgtcgtaccttagttacgtgtcgacggttcggtacgggaccgaagggcctacggacgttacccgtaccggttaccctcccgtaccgtaccgtaccccctacccgtaaacccgggaaccggtacccctacggtacccggttcccccgtttcccggccgggttaccccgtccccggtaccgtcccgtacggtaacccggaccgtacccctacccggttaacccgggaacgtcccgaacccgtaccgggg

SEQ ID NO: 147022 - DNA, 663 bp, Homo sapiens
  misc_feature: GYAE6OF01BEYIW.21.70.G04.1.454.CMB.1.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcactggggctggatccgccagcccccaggggaagggctgggagtgggttgcgtagttattttcatgatgggaccacctactataggtcgtcgctcaacngtcagtcaccatactccgtagacacgtccaggaaccngttctccctgacgtctgaactctctcgaccgccgcagacggtcggtatatatttagttgtgcgtaagactagttaggtggtattcggcttacctccgtacccttagttacggtagtggtacgtcgcggggtaccgaaggggaccgacgtacgtaccacccggttcctccgtccacggtaccctaccgaacccgaacgggtccctaacgttcccggttacccgttcccccgtacggtcccgtcccgtcgccgtccgacggccgaccacccgtcgacggacgcctacgaccgccggcccggtaggccgtcggtccgtacggtaccgtaaccgggtaccttacccgttccccgtcgttaccctaccgtacgtcgggacggtcgggtccggcggtacggaccggg

SEQ ID NO: 147023 - DNA, 857 bp, Homo sapiens
  misc_feature: GYAE6OF01CS34Q.21.70.G04.1.454.CMB.1.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtggggctggatcccgccacgcccccgaggggaagggcgtggaggttgggttgcgtagtttnttttcagtgagtcggacccacctactagtaggtcgtcgctacaacgngtcgacgtccaacctatacgtccgtaacgacctaccgtaccgaacggaacccttagtttccctcccgtaggaacgtctacggtaaaccttccttacgtccggaccccgaccgaccgaacggaccgggtacgggtttaattaattacgtttacgttggtacggaccggtaagacttaagttaggtaggtttacgtacggtccttaacgttcccgtaaccgttaggtttacggttacgtacggtaccggtttcggtcggggaacccgaaacggggccacgtaaccggtcccgtaacccgttcctacccgtaccgacccggtaccctaccccgaaccggaacccgggtacccctacggttaccccgtttccccgttacccccgtcgggcccccgtcccgtcgtaccctccggaccggaccgaccgtacccgtacccggaagacccgacgtacccgaccgggtccccgtaccgggtccggtccgtaccggtaccggtacgggtaccggtaaacccggtttaccctttacccccggtttcccgtttccccgttacccgtttaccgttaccgggttacggtaaccggggtccgggttacgtacccgggggaaccgtaacccgggg

SEQ ID NO: 147024 - DNA, 641 bp, Homo sapiens
  misc_feature: GYAE6OF01B37FG.21.70.G04.1.454.CMB.1.raw
  modified_base (411)..(411): a, c, t, g, unknown or other
  misc_feature (411)..(411): n is a, c, g, or t
  modified_base (551)..(551): a, c, t, g, unknown or other
  misc_feature (551)..(551): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttattttcatgatgggaccacctactataggtcgtcgctcaacagtcgagtcaccatatccgtagaccacgtccaaggaaccagtttcctccctagaacgctgaaaccttctctcgaccgcccgcaacgaccggacgggtattatatttattgtgcgagacatagtggtattggctacctcgcccttagtacggtagtcgggtaccggtccgggggaccaaagggggcccncgacgtccgacccgtcctcctcacgccctaccaccgaacgggcccagtccgtaccgttcccctggcccgtcccgtacgcctcccgacggtcgaccctacccgtcgacgacgccaacgtcggcccggtcccgtcgggtccncggtccgtgggtacccgtaaggtaccccttacgtttccccgtcgttccttcgtaacgtcggtacggtccgggctcgggactacgggcccg

SEQ ID NO: 147025 - DNA, 769 bp, Homo sapiens
  misc_feature: GYAE6OF01B590J.21.70.G04.1.454.CMB.1.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtggggctggactccgccacgcccccgagggagggctggagtgggttgcgagttattttcatgatgggaccacctatagtaggtcgtcgctacaacngtcgagtcacatactccgtagacacgtccaaggacctagttcctccctagaacnctagaactctcgcgacccgccgacgacggacgaggtactagtactttgttggngcgagaactagtaggtgttacttggcttacgtccgtacccgttagttacggttacgtggtaaccgtcggtcggggaccgaacgggaccctacgacgtaccctaccggttcctcccgtacgaccgtaccccgtacccaacccggtaaccgggacccctacgtttccccggttcccgtttccccccggacgggtccccgtccccgtcgtcccgtacccgtacgggacctacccgacccgtccggaacgaccgacccgaaccggaccggtcccgggtacccggttccgggtcccgttacccggttccgtaaccgggtaccgtaaacccggtttaaccccgtttaccccgtttacccccggttaccgttccccgttaaccccgttacggtaacccggggtaccggaccggggttacccgtacgggaccggtaaaccgggg

SEQ ID NO: 147026 - DNA, 691 bp, Homo sapiens
  misc_feature: GYAE6OF01EWXHV.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggactccgccacgcccccgagggaagggctggaggtgggttagcgtagttattttcagtgagtgggaccactactagtaggtcgtcgctacaacagtcgatcactatactccgagacacgtcaagacctagtctacctgaacgtctacgaacttcctctcggaccgtccgcgaacggacgtcgggtaattagtattagttgtgcgagactagtagtaggttagttcggtcttaccgtcccgtaccgttaagttaccggtatacggggtacgttcgggtaccggggtaccggaaccggggaccgtacgacgttaccgacccggttacctcccgtacgaccggttccccctacccgtaacccgggaaccgggtacccctacggttccccggtttcccccttcccccgggttaccgggtccccgtacccccgttcggccccgttaccggacgggaccctacccgtaacccccgtcggaaccggtccgtaccgaacccggg

SEQ ID NO: 147027 - DNA, 598 bp, Homo sapiens
  misc_feature: GYAE6OF01EAKPB.21.70.G04.1.454.CMB.1.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (346)..(346): a, c, t, g, unknown or other
  misc_feature (346)..(346): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttatttttcatgatgggaccacctactataggtcgtcgctnaacngtcgagtcaccatactccgtagacacgtccaggaaccagttcctccctgaagctagaactctctgacccgccgcacgacgcgggtaatatattagttgtgcgagacatagtgtatgctacncgccctagttacggtatggacgtcgtacggggaccgaagggaccgcaggtccacccgtctccctcacgcccctccgaccgaacgggccccagtccggttccctttcccccgtcggccgtcccncgtcctccgaggcnccacctccgaacgcgaccgacgacggccggtcccgtgggcctcgccgtcggtacgaacggtccttaccgttccctcgtcctccgtacgtcggacggtccgggcgtggcgtaacgg

SEQ ID NO: 147028 - DNA, 645 bp, Homo sapiens
  misc_feature: GYAE6OF01D8D0V.21.70.G04.1.454.CMB.1.raw
  modified_base (322)..(322): a, c, t, g, unknown or other
  misc_feature (322)..(322): n is a, c, g, or t
  modified_base (391)..(391): a, c, t, g, unknown or other
  misc_feature (391)..(391): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccaggggaaggggctgggagtgggttgcgagttatttttcatgatgggaccacctactataggtcgtcgctcaacagtcgagtcaccatatccgtagacacgtccaggaaccagttctccctgaagctgaactctctcgaccgccgcacgacgcgggtatatattagttgngcgagacatagtgtattggctactcgccctagttacggtatcggactcgtggggacccaaggggacccncgagtccaccggtcctccgtcacgccctaccgaaccgtaacgggcccctagtccggttcccttccccccgtcggcccgtcccctcggtccctccgacgggaccgccgacccgtcggaacggacgaccgaaccgacgggcccggcccggtacggggcctcggtcccgtacgggtacgtaaaccgggtacccttacccttccccgtcggttcccttaccgtacgtcggaacggccgggtacgttgggccgaacggg

SEQ ID NO: 147029 - DNA, 736 bp, Homo sapiens
  misc_feature: GYAE6OF01A2C27.21.70.G04.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagtgtagtgtgaagggaaagggtctccgaagccttcggagaccctgtccctcacctggcactgtctctggtggctccatcatcaatggtcattatcactggggctggatccgccagcccccagggaaggggctggagtgggttgcgtagttatttttcattgatgggaccacgtactataggtcgtcgctcaacagtcagtcaccatactccgtagacacgtccaaggtaaccagttcctacctgaacgctgaactctctcgaccgccgnagacgcggtatatatttatcgtgacgagacatagtggttaattcggactacgtccggtacccttaagtttaccgggtatacggggaccgtttacgtcggggggtacccaaagggggacccgcgttaaacggtccctaacccgggttcttccccgttaccgaacggtcccctaccgaacccggtacggggaccccctaacgttcccgggttccctttaccccccgtgggtacccgtccccgtcgtaccccgttaccgaacgggtaccggaccctaaccccggtttcccgaaccggaacgacgtaaccaccggtacccggggtcccctacggggtacctaccggtcccgtagggtacccgaaacgggtaacctttacccctttcccgtcccgtaccttaccgttacgtcgacggtccggcgttcggccgtaacgg

SEQ ID NO: 147030 - DNA, 797 bp, Homo sapiens
  misc_feature: GYAE6OF01EEUBA.21.70.G04.1.454.CMB.1.raw
  modified_base (783)..(783): a, c, t, g, unknown or other
  misc_feature (783)..(783): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatactaatggtactattatcgacgtcgggctggactcccgaccaccggacccccggaaggggaacggggtcgtgggtaggttgggtcgacgttaaggtttattttcagttagtacggtacggaaccctacgtaacgtagttacggtcgtcgacgttaccaacgtacgtacgtaacgtccaaccgtaattaccgtaaccgtacgaaccgtaccggtaccgaacggtaaccgtacgtttaccctaccgtaggtaaacctccgttaagaaccttccgtaccggtaccgaccggtacccgtacggaacggtaccggtaggttaaccttaagttaacgtttagtacgggttaggaaaccggaattacggtaagttaggtacggtttacgtacggtacttaaccgtcccgttaaccgttaacgtttaacgggttacgtcgggttacggttcgggtaccgggtaaccggaacgggaccgtacgtacgtaccgtacccgtttcacccgtcgaacccgtcccgaaccgacccgaaccgggtccctaacggttcccgtaccccgttccccgtcggtacccgtccctcggtcccgtaccggcgaccggtccctaccggtccgaacnccgacgtacccggg

SEQ ID NO: 147031 - DNA, 783 bp, Homo sapiens
  misc_feature: GYAE6OF01DVBRA.21.70.G04.1.454.CMB.1.raw
  modified_base (191)..(191): a, c, t, g, unknown or other
  misc_feature (191)..(191): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtgctccatcatcaatgtactattancacgtgggctggactccgccacgccccgagggaacgggctggtagtgggtgcgtatttattttcatgagtacggacctactatagtacggtcgtcgctacaactaggtacgacgtacaaccctattacgttaccgtaacgaccgtaccggtaccaacgggtaacctacgtttccctacccgtaagaacgtcgttaacgaaccttccgttacgtacccggacccgaccgtacgacggtaccggtacggttactaagtttaacgtttaagttggacgtacggtacgtaacgtaagtttacgggttacggtttacgtttacggtacttacccgttaccggttaccccgttaaggtttaaccgggttaagtacgggttaccggtttaccgggtaccgggggaacccgtaacggggtacccgtaacgtaaccgtacccggtaccgtttccctaccgttccgaacccgtaccccgttacccgaacccggaaacccgggtccctaccggttcccggttacccccgttccccggtccgggtcccctacccgtcccgaccgttacccggacggtacccacccgttacccgcgaggtacccg

SEQ ID NO: 147032 - DNA, 582 bp, Homo sapiens
  misc_feature: GYAE6OF01EXR0S.21.70.G04.1.454.CMB.1.raw
  modified_base (357)..(357): a, c, t, g, unknown or other
  misc_feature (357)..(357): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggactccgccacgcccccaggggaggggctggagtgggttgcgtagtatttttcatgagtgggaccacctactataggtcgtcgctcaacagtcgaagtcaaccatactccgtagccacgtccagggaaccagtctccctgaagctagaactctcngaccgccgacacgacgcggtatatattatgtgcgagacagtagtgtagttcgctacgtcgtcctattacgtagtcgcgtgngggtcgaacggcgcgagtccncggtctcctctacgccctaccaccgtaacgggcccctacgtcccgggttacccttccccccgtaggtccccgtccccgttgcccctcccgtacgggacgaccctacccggtccgaacggaccg

SEQ ID NO: 147033 - DNA, 649 bp, Homo sapiens
  misc_feature: GYAE6OF01ERB59.21.70.G04.1.454.CMB.1.raw
  modified_base (604)..(604): a, c, t, g, unknown or other
  misc_feature (604)..(604): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtcccctcacctgcactgtctctggtggctccatcatcaatggtcattatcacgtggggctggactccgccacgcccccgaggggaacggggctgggaggtcgggttgacggtagttatttttcatgagtcgggacctacctactagtaggtccgtcgctacaacagtcgacgtcaacctatactccgtacgacaccgtaccgacggaaccctacgtttcctcccgtagaacgccgttagaaccttctacgtcgacccgtccgacacgaccgggaggttaataagttatttagtgtggaccgtagactagttaggtaggttattggtcttacgtccgtaccttagttacggtagtcggtacgttcggtagggacgaacgggccgacgtacgtccgaccgttctccgtcgacgtcccctaccgaaccgaccggccctacgtcccggttccctccccgtcggcccgtcccncgtccaccgacggacgcccacccgtacggacgtacgcctaccggg

SEQ ID NO: 147034 - DNA, 840 bp, Homo sapiens
  misc_feature: GYAE6OF01ACJJU.21.70.G04.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagtgtagtgtgaagggaaaggtctccgaagccgttcggagaccctgtccctcacctgcactgtctctggtggctccatcatcaatggtcattatcactggggctggactccgccacgcccccgagggaggggctgggagtggttcgcgagttattttcatgatcgggacctacctacgtatacggtcgtcgctacaacagtcgagtcaccatactccgtagaccaccgtccaacggaacctagttcctacccgagaacgtcctagaacttctcgtacgaccgccncgacgacggcggtaatactattacgtgtcgacgtagacgtagtacggtggtaagttcggaccttaccgttccggtacccttaaggttacggtctacgggtaccgttcggtacggggaccaaacggggccctagtaccgtacccgtacccggttcctacccgtacgacccgtcccctacccgaacccgggaaccgggtccccttaacgggttccccgggtttacccccttttaccccccgggacggggtccccgtaacccccgttcgggtaaccccttacccgggaaccgggtacccttaccccgtaaccggttaccccggaaggacccgaccgtaaacccggcggtaccccggggtcccggttacggggtccttaccgggtacgttaacccgggtaaccgtaaacccgggttacccgtttaaccccggtttcccccgttacggttaccgtttaaccccgttaacgggtaccggggttaaccgggtcccgggtaccggttaaccggaccggtaaaccccgggg

SEQ ID NO: 147035 - DNA, 821 bp, Homo sapiens
  misc_feature: GYAE6OF01B0LC1.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtctattatcacgtggggctggactccgccgacgcccccgaggggaagggcgtggagtgggttgcgtagttattttcagtgatcgggaccactactatacggtctcgctacaactagtcgagtcaaccatactccgtagaaccaccgtaccaaggaacctagttcctaccctagaaacgtctacgaacttcctacgtcgaccgccgacacggacggtacgggtaattacttatttaagtttcggtagtacgaagtaacgaagtttacggttaggttaagtttcggtaccgttaaccgtccggttaccctttaaggtttaccggttaaggttcggggtaaccgtttccggtacgggggacccggtaaacggggtaccccgacggtaacccggttacccgtaccccggttacccgttaccccgtaccgtaacccggtacccccgttaaccccgaaaccccgttaaacccgggggacccccttaaaccggggtttcccgggtttacccccccgtttcccccccgggtttacggggtccccccggtcccccgtttaacccggtccccggtaccccgtaaaggggtaaccccgtaccccgtaacccccggttaacccgggaaccggttaacccgggacccaaaccccgggg

SEQ ID NO: 147036 - DNA, 594 bp, Homo sapiens
  misc_feature: GYAE6OF01EVEL6.21.70.G04.1.454.CMB.1.raw
  modified_base (472)..(472): a, c, t, g, unknown or other
  misc_feature (472)..(472): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtgctccatcatcaatggtcattatcactggggctggatccgccagcccccgagggaacgggctggagtgggttgcgagttatttttcatgatggaccacctactagtaggtctcgctcaacagtcgagtcacctatactccgtagacacgtccaggaacctagttcctcccgtagaacgctgtaactccgtctcgacccgccgcacggacggtcgggtaatattatttattggtgcgaagcacgttagtgttattggctactcgaccttagttacggtatggtacgtcggtgggaccaagggaccncgacgtcacccgtcctcctcgacgccctaccaaccgaggccctacgttcccgtacccgtttcccccgtggccccgtcccgtcgacccttcccgacggtcgaccgtaccctcccggagaccgg

SEQ ID NO: 147037 - DNA, 770 bp, Homo sapiens
  misc_feature: GYAE6OF01C6JKT.21.70.G04.1.454.CMB.1.raw
tcagtcgtcgctcgcacgaccggtgctcgatttagtgtagtgtgaagggaaagggtctccgaaggcttcaccagtcctgtcccagctgcagtctgcaggagtcggccaggactgtgaagccttcggagaccctgtccctctaccgtgcactgtctcttggtggctccattcatcaatggtctattatcacgtgggctggactccgccgacgtccccgagggacggcgtggtacggtgggttcgcgtagttacttttccgagtgaagtcgggacctaaccttactagtacggtcgtcgtactacaactagtacgacgtcacgtagtacgtaccgtacgaccgtacgtaccgaacgggaccttacgttccgtaccgttaggaactccgaacgtaactcgtacgtacggaccgtccgacacggtacggtacggtattacgttaagttcgttaggcgacgtaacgaacgtagttaacggtgttacgtttcggaacttccgtaccggttaccttaagttaaaccggtgtaacgggtcgttacggtacggggtaaccgaaacgggtccctaaggtacctaccgggtaaccttcccgttacccgtaagtaacccggtccctaacccgaaaacccgggccgggttaacccctttccggttaaccccgggttttccccgtaccccggtcgggcccgtttaccccgttacggtacccgtacgggtaaaccgggcctaaccccgtaaccggtcggaaaaccggtcgtaaccgtaacccggg

SEQ ID NO: 147038 - DNA, 633 bp, Homo sapiens
  misc_feature: GYAE6OF01B62HX.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgcccccgagggagggctggaggtgggttgcgtagttatttttcagtgatcgggacctacctactagtaggtcgtcgctacaacgagtcgagtcaccatactccgtagacacgtaccgaggacctagttctcccgtagacgctagaactctctcgaccgccgcacggacgcggtatagttattatgtgcgagactagtagtggttattggacttacgtcgtacccttagttacggtatcgggtacgtcggtcggggaccgaagggcccgacgtacgtccgacccgttacctccctaccgacgtccctaccaacccgacgggacccctaccgttacccggtccccttcccccggtacggtcccgtaccccgtcgcccgttacccgacggacgtacccacccggtacccggactcggccgtaacccggg

SEQ ID NO: 147039 - DNA, 726 bp, Homo sapiens
  misc_feature: GYAE6OF01AT1AM.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctgggagtgggttgcgagttatttttcatgatcgggaccacctacgtagtaggtcgtcgctcaacagtcgagtcaccatatcgtagacacgtccaggaacctagttctccctgaacgctagaactctctcgaccgctgcaggacggtcggtatatattagtgtgacgagacagtagtggtattcggctaccgtccgtccttagttacggtagtcggtacggtcgtgggggtacccaaggggcccgcgaagtccacccgttcctccgtccgacgccctaccgacccgtaaccgggcccctacgttcccggttaccctttccccccgtacgggtcccgtaccccgtcgcccgttaccggaacgggaccggtcccgtacccgtacccggtaacggacgtaccgaaccgcgggtaaccccgggtcccgtacggggcccgttcggtccccggttaggggtacccgtaaccgggttacccttaaccccggtttccccgttaccgttcccgttaccgttaaccgggtacggtaccggggtccggggtacccggttcggggaaacccggg

SEQ ID NO: 147040 - DNA, 760 bp, Homo sapiens
  misc_feature: GYAE6OF01CIDIX.21.70.G04.1.454.CMB.1.raw
  modified_base (266)..(266): a, c, t, g, unknown or other
  misc_feature (266)..(266): n is a, c, g, or t
  modified_base (485)..(485): a, c, t, g, unknown or other
  misc_feature (485)..(485): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccgttcggacgaccctgtccctcacctgcactgtctctggtgctcatcatcaatgtactattatcacgtgggctacggactccgaccaccggccccgagggtaacggggctgggacggtgggttcgcggtaagtttacgttttanagtgacgtcgggaacctaccgttaacttagtacggtcgtcgtactacaacgtcgtacgtacgtacacgtaatacgaccgttagaccacgtaccgtaacggaacctacggttcctacccgtaggaaccgtctaacggaccttacgtaccgtaccggtaaccgccgacgggaaaccggtcgggtaaacccggtagtttaaacttagtttaaggttaccggnggtaaccgtaaacgtaacgttagtaaccgggtttattaacggttacggttacttaaccgttaccgtttaaccgttagttttaaaccgggtaggttacggtaaccgggttcgggtaaccggggaccgttaaccggacgtccgtaaacgtcgtaccccgtatacccgtcctacgccctaacccgacgaccgtcctacggttcccgtccctcccggtacggcccgtcgtccaccgtaccgaaggtaccctcccgtaccgaccgaacgcgtacgaccgg

SEQ ID NO: 147041 - DNA, 811 bp, Homo sapiens
  misc_feature: GYAE6OF01C59Q6.21.70.G04.1.454.CMB.1.raw
  modified_base (106)..(106): a, c, t, g, unknown or other
  misc_feature (106)..(106): n is a, c, g, or t
tcagtcgtcgctcgcacgaccggtgctcgatttagtgtagtgtgaagggaaagggtctccgaaggcttcaccagtcctgggtcctgtcccagctgcagctgcaggngtcggccagactggtgagccttcggagaccctgtccctcacctcgcactgtctcgtggtcgcctcctatcactacaagttggtactatttactccgacggttcggggctacggctcccgaccgaccgccccggaagggacgggtcgtaggtacggtcgggtcgacgttagtttattttcgagttgacgtacggaccctacttacgtaacgttcggtaccgtcgacctacgaacgtcgtacgacgtcaacctattacggttaccgaacgtaccgtaccgtaccgaacggtacctcggttccctacccgagaacgttacctactaccgtcttccggtacccgccgacgacgtaacggtacggttaactaagtttgttaacggttcggactacggtactaagtacggttaggttacggttaacgttcgtcctacgttccgttaacccgtttagttaaccgggtctaacgggtacccgggttacggaccggggtaccgtaaacggggtaccctcgtaccgttaccgtacccggttcccttcccgtaccgtacccgtacccgtaaccccgtacccggttaaccggtccccgtaaccccggtttccccggttaaccccgttcccccggccgggttccccgtaccctccggtacccttaacccggacgtacccggacccttaaccccgaacgtacgggtccctaaccccggg

SEQ ID NO: 147042 - DNA, 561 bp, Homo sapiens
  misc_feature: GYAE6OF01B2FA1.21.70.G04.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (555)..(555): a, c, t, g, unknown or other
  misc_feature (555)..(555): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagccccccaggggaaggggctggagtgggttgcgagttatttttcatgatgggaccacctactataggtcgtcgctcaacagtcgagtccaccatatcccgtagacacgtccaggaaccagttctccctgaagctgaactctctgaccgccgcagacgcggtatatattatgtgcgagacatgtgtatggctactcgcctatacggtatggacgtcgnggggccaaaggggccncgagtccaccgtctccctcacgccctccaaccaacgggccccagtccggtaccttccccccgtggcccgtcccgtcgtcctccgaggacgccaccgtccgagacgccacgacgccggcctgggctgcctggtacaacggactaccttccctcgtctctactcgacgcgggctggngaacgg

SEQ ID NO: 147043 - DNA, 766 bp, Homo sapiens
  misc_feature: GYAE6OF01DYSVX.21.70.G04.1.454.CMB.1.raw
  modified_base (232)..(232): a, c, t, g, unknown or other
  misc_feature (232)..(232): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtggggctggactccgccacgccccgagggagggctggaggtgggtgcgtagtttattttcatgagtcgggacccacctactagtacggtcgtcgctacaacngtcgagtcaaccatactccgtagaccacgtccgaggaacctagttcctccgtagaacgtcctagaaccttctacgtcgacccgccgacacggacggtcggtaattattactttagttggtcgacgagactagttagtggttatcggacctacgtccgtaccttagttaacgggtagtcggtacgtcggtacggggaccgaaacggggtcccagtaacgtccgtaacccgttcctccgtacgaccgtcccctaacccgaacccgtaaccggggtcccctacggttccccggttcccgtttacccccgcgggtaccccgtccccgtacgtcccgtaccgacggaccgccccgtaaccgtaccggaacgtaccgccaaccggaccgggtcccggtaccggtcgggtccctccgggtcccgttacggtaaccggaaaccggttacccgttaaccccgggttcccggaacgggtacccggtaaacggtacccgtaggggtacccgggtaccggggccgtacgggaacccgtaaccgggg

SEQ ID NO: 147044 - DNA, 776 bp, Homo sapiens
  misc_feature: GYAE6OF01B9I14.21.70.G04.1.454.CMB.1.raw
  modified_base (199)..(199): a, c, t, g, unknown or other
  misc_feature (199)..(199): n is a, c, g, or t
  modified_base (299)..(299): a, c, t, g, unknown or other
  misc_feature (299)..(299): n is a, c, g, or t
tcagtcgtcgctcgcacgaccggtgctcgatttagtgtagtgtgaagggaaagggtctccgaaggcttcaccagtcctgtcccagctgcagctgcaggagtcggacccaggactggtgaagccttcggagaccctgtccctcacctgcactgtctctggtgctccatcatcaatggtctattatcacgtgggctggacncccgcgacgaccccgagggtaaggggctaggaggtggtcgcgagttattttcaagtgagtacggacctacgtaactagtacggtccgtcgacttcgaacngtacgacgtcaaccatacgtcgtaacgacacgtaccgaacggtaacctacggtttacctacccgagtaaacggtcgtacgtaaaacctcgttacgttaccggaaccccgaccgtacaaccggaacggtacgggtttaaattaagtttaactttaggtttacggttaacggcggtaaaacgagttaatttaggttagggttaacgttacgggtcttaacgtccccgttaacgtttaacggttaacggttacggtacgacggttcggtacgggtaacgtaaacgggcctacgaccgtccgtacccggttacctaccgtaccgtaacgtccctaccgaaaccgaccgggtcccctaacggttcccgttaccccgttaccccgtaccgggtcccgtcccccgtacggttccccgaacccggtacggtaacccgtccgtaacccccggttacgaaccggtaaccgttacccgaaacccgggg

SEQ ID NO: 147045 - DNA, 915 bp, Homo sapiens
  misc_feature: GYAE6OF01CNN6P.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtgggctggactccgccacgcccccgaaggggaaggggctgggagtgggttgcgtagtttatttttcatgagtcgggacccaccttactagtaggtcgtcgcctacaacagtcgagtccaccatactccgtaagacaccgtaccgacggaacctacgttccctacccgtaggaacgtctacgtaaccttcccgtacggacccggccccggtccgaacggaccgggtacggggttaagtttaaacttagtttacgtttacggttcggaccggaaacggtaactaaggtttaagggttagggttacggtttaggtaccgttaacccgttccgtaccccgttaacgtttaacgggtttaacgtcggggtaccggtacgggttaccgggggacccggaacggtaaccgggcccgtaaccggttccggtaaccccgttccttccccgttaccgacccgtacccccgttaaccccgtacccgaaccccggggtaccccgtacccgttacccgggtttcccccgtttcccccggcccgggtaccgtcccccggttcccgcccgttaccgaccgggtacggacccctacccggtcggaacggaccgacccgtaaccgaccgggtcccgggtccccgtcggggtcccttacgggtcccggttacgttacccggggtaaacgttaccccggtttaccccttttcccggttaccccgtttccggttaacccgttaccggttaccggggtaccggggttaccgggcccgggttaacggggccggaaacggggtcccg

SEQ ID NO: 147046 - DNA, 843 bp, Homo sapiens
  misc_feature: GYAE6OF01BAF63.21.70.G04.1.454.CMB.1.raw
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaacgccttcggagaccctgtccctcacctgcactgtctctggtgctccatcatcaatggtcattatcactggggctggactccgccacgcccccgagggaaggggctgggaggtgggttgcgtaggttatttttcagttggatgggaccctaccgttaactagtaggtcgtcgcttcaacgagtccgcgtccaacctatacgttaccgtagtaccgaccggtccaacgggaaccctaggttccttccccgtaggaacgttctacggtaaacctccgttacctacgacccggtacccgaccgtaacggaaccggccggggttaattacctttagttttaaacgtttcggttacggccggttaacggaaccctaggtttaaggtttacggggtttacgtttaccggggtaccccgtttaaccgttcccggtaaccccgtttaaggtttaacccgggttaaggttacggggtaaccggttcgggttacggggaccccggtaaacgggggtaacccgcggttaaccgtccgtaaccccggtttcccgtcccctacccgtacgtacccccgttacccaacccggtaaaccggggtccccctaaaccggttccccgggttcccccgttttaccccccggcccgggtccccggttacccccctccgggtaacccccttccgaccgggtacccgtaccccgaccccgttacccggaacggacccgg

SEQ ID NO: 147047 - DNA, 1002 bp, Homo sapiens
  misc_feature: GYAE6OF01CDY86.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagtccttcggacgaccctgtccctcacctgcactgtctcgtggtcggctccatcactacaagttggtactaagtttactactacggtcggggtacctagggaccgtcccggacccgaccgggacccccggaagggggtacggggcgttacggggtagggttgggggttcggtacggttagtttacgttttttacgaacggttcggtaacggttaccggggtaacctaacccgtttaacggttaacggttaacggggttaccgtccgtaaccgttaaccaaacggttacggtacggtaccgtaaccctaaccgtaacgtttaaccgttacccggtaaccgggtaaccgttaacccggtaaacccggaaccggttaaacccgtttaccgttaccccgttacccggtaaaggaccgttaccgtaaacggtaaccttccgtaccggtaccggaccccgggtaccgaaccggaacgggtaaccggtacgggtttaaacttagtttaacgttttacggtcggtacggtaacgtaaaggttaaccttaggggttacgtttacggttacgtttcgggtaaccctttacccgtacccgtttaacccgtttaacggtttacgggttaaccgggttcggggttaaacccgggttaccggggttacccgggggaaacccgggtaaacggggtccccgtaacgtaccgggtttacccgaaccccgggttttcctaacccggtccgaacccgttcccccgaaacccggtacccggtaacccgggccccgttacggttaccccggttccccggtccccgaccgggttcccgacccgtccgtcggtaccggaccggtaccgtccctaaaccgggcggaccgaaccggtaccgaccgggg

SEQ ID NO: 147048 - DNA, 758 bp, Homo sapiens
  misc_feature: GYAE6OF01BJ6W4.21.70.G04.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcactggggctggatccgccacgcccccagggaaggggctggagtgggttgcgagttatttttcatgatgggaccacctactataggtcgtcgctcaacngtcgagtcaccatactccgtagacacgtccaaggaaccagttcctccctagaagctgaaaccttctcctagacccgccgacgacggccggcgggtaattacttaatttattggtggaccggaagtaactagttaggttagggttagtcggtacttaccgtccgtaccttaggttacggtgtacgggtccgtcgggcgggaacggtaacggggaccacgtccgtaacccgtccggttaccttccgtacgacccgtaccccgtacccgaaaccgggtaacccgggcccttaacggtccccgtttaccccgttccccggccgggtcccgtcccgtaccggtccctaaccggacgggtaccctcccgtaacccgtacggaacgaccgaccgtaacggccgggtcccggtacccgggtcggtaccgtccgggtcgtacgggtaaaccgtaaccggtcccgttaaccccggtaccggacggtaccgtaaacccggtcgacggggtacgggcccgggttacggccggtaaccgggacggg

SEQ ID NO: 147049 - DNA, 679 bp, Homo sapiens
  misc_feature: GYAE6OF01CT2UD.21.70.G04.1.454.CMB.1.raw
  modified_base (178)..(178): a, c, t, g, unknown or other
  misc_feature (178)..(178): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (314)..(314): a, c, t, g, unknown or other
  misc_feature (314)..(314): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggacgaccctgtccctcacctgcactgtctctggtgctcatcatcaatggtntattatcacgtgggctggactccgccacggccccgagggacgggcgtgggaggtgggtgacgtagttattttgatgatcggaccaccttatntacggtcgtcgctaccaancgtcagtcacatacgtcgtacgacncgtacaacggaacctcgtctcctagatcctagtacctctcgtcgaccgtccgacgaaggcggtcggttaatacttagttagttgtacgacgtagactaggttacgtgttacgtcgactacgtccgtaccgttattaaccgggtgtaccgggtactccgggacgggaccgaacgggtacccgtacgacggttaccctacccggtacctttaccccggactcggttcccccaacccgtaaccggaaccgggtccccctaggtttccccgggttccccccttacccgggcggtcccctcccgttaccggtacccgtcccggaacggtacccttacccgacccgttaccggacgacccgtcccggaacg

SEQ ID NO: 147050 - DNA, 614 bp, Homo sapiens
  misc_feature: GYAE6OF01AUG1E.21.70.G04.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccagggaagggctggagtgggttgcgagtatttttcatgatgggaccactactataggtcgtcgctcaacagtcgagtcacatatccgtagacacgtccaggaacctgttctccctgaacnctagaactctctcgaccgccgcagcgcgggtatatattattgtgcgagacagtagtggttatggctactcgcccttattacggtatggacgtcgtcgggcaggccgcagtcacgtctctcagcctccaccaacggcccagttccggtccttcccccgcggtcccgcccgtcgcctcccgaggcgccgaccctccggacgacgccgtaacgaccggccggccccgtcgggcctcggcccgttacgtaccggaaccggtcccttaacccgtttccccttcccgttaccgttcccgttaaccgttacgggacggaccgggggtccgttcgggtccggaaaccgggg

SEQ ID NO: 147051 - DNA, 647 bp, Homo sapiens
  misc_feature: GYAE6OF01CE5WP.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttcctccctgaagctagaactctctcgaccgccgcagacgcgggtatatattattgtgcgagacatagtggtattggctactccgcctattacggtatggacgtcgtcgggaccaagggaccgcacgtccaccgtcctcctcacgccctccgaaccgaacgggcccctacgttcccggtccctttccccccgtcgggcccgtccccgtcgtccctcccgacggacgtcccacccgtcccggaacgaccgaccaccgacggcccgggacccgtcgggaccgtccgtcccgtcgggtaccgaacggtacccttacccgttcccccgttcgttacccttacccgttaccgtcgggtaccggtcggggtccgtcgggtaccgaaccgggg

SEQ ID NO: 147052 - DNA, 861 bp, Homo sapiens
  misc_feature: GYAE6OF01C3YN2.21.70.G04.1.454.CMB.1.raw
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtgggctggactccgccacgccccgagggagggctggagtggttgacgtagtttattttcagtgacgtcggaccactactagtaggtcgtcgctacaacgacgtacgagtaccaactatacgtaccgtacgaccaccggtaccaacggtacctagttcctacccgtagaacgtctacgaacttcctgtccgaccgccagacggacggtacggtattaagttnttagtcggngtacgagtaactagttacggtgttaacgcggtaccctagttacccgtacccgtttaaagttaccgggtaagtcggggtaacccggtttccgggtacgggggaaccaaaaccgggggtcccgtaaccgaaacggtttcccctacccccggttgttaccccctaccgtaacccggtacccccgtaacccggaaccccgggtaaccccgggtacccccgtaccggtttccccggttaccccggtttcccccggtcccgggtacccccgttccccgtaccggtaccccgtaccggtaacccggaacggtcccgtaacccgtcccgggaaccgaccgtaacccgaacccggtacccggaccgggtcccccggttcgggtcccgttacggtaccccggttacgggaaccgttaacccggtaaccgtttacccccgtttacccgtacccggttccttaccggttacgtccgggtaaccggccggggtaccgtacgggcggtaaccggg

SEQ ID NO: 147053 - DNA, 662 bp, Homo sapiens
  misc_feature: GYAE6OF01CGPME.21.70.G04.1.454.CMB.1.raw
  modified_base (444)..(444): a, c, t, g, unknown or other
  misc_feature (444)..(444): n is a, c, g, or t
  modified_base (645)..(645): a, c, t, g, unknown or other
  misc_feature (645)..(645): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtgggctggactccgccacgcccccgaggggaacgggctggaggtggttgcgtagttattttcatgagtgggaccacctactatacggtcgtcgctacaacacgtcgagtacacatatccgtagacacgtaccgagaaccagttccctcctagaagctagaccttctcgtcgacccgcgcaggacgacggtatatattatgtgacgagacagttagtgtagttggccttacgtccgtacccttagttacggtagtcggtaccgtcggtacgggacccgtaaggggacccgcgacgtacccgtaccgtcttacccncgacgtcccacccgaaccgacggccctacgttccggttacccttcccgtcggacccctccgtccgactccgagtaccgaccccgtaccgtaccgaacggaccgaccgaaccggtccggcccgggtacccgtcgggacttccggaccgtcggtaaccgtaacggtaccctaccgtcccggacaccgacgacgtcggaccggngaccgtggaacgtacgg

SEQ ID NO: 147054 - DNA, 934 bp, Homo sapiens
  misc_feature: GYAE6OF01DUBYV.21.70.G04.1.454.CMB.1.raw
  modified_base (232)..(232): a, c, t, g, unknown or other
  misc_feature (232)..(232): n is a, c, g, or t
tcagtcgtcgctcgcacgaccggtgctcgatttagtgtagtgtgaagggaaagggtctccgaaggcttcaccagtcctgtcccagctgcagctgcaggagtcggcccaggactggtagaacgccttcggacgaccctcgtccctcacctgccactgtctcgtggtcgctccatcatcaatgtctatatcgcgtgggctggactccgccaccgcccgagggacgggcgtaggnggtggtgacgtagttacttttcagtgagtcggaacctacctattaagtacggtcgtcgctacaacgtgtcgacgtcactatactaccggaagaccgtacgccgtaacggaacccttagtccctacccgtagtaacgtctaacgtacttcctacggtcggaaccccgcggaaccgtaacggtaccgggttaaggttaaacgttaacgtttacttttacggtaggttccggaaacgttaacgaaaccggtttaagtttaagggttaccggttaacgggtttacgtaacccgttacccggtttacccccgtttaaaccccgttttaaacggggtttaacccgggttaagggttttaccccggggtaacggtttacccggggggtaaaccgggggtaacccgtaaaaccgggggttacccccgaagggtttaaccccggtaacccgggtacccccgtttaccgttacccccgttaaccgggaccccgttacccccgttacccggtaaacccggtaacccgggttaacccccttacccgggttttaccccccgggtttccccccttaccccccgggggtaccggggtaaccccccgttcccccggtaaccggtttacccccgaaacccgggtaaccgggttaacccccgtacccggttaaaccccggggtaaccccgaggaaaccccggttaacccggaaccccggg

SEQ ID NO: 147055 - DNA, 785 bp, Homo sapiens
  misc_feature: GYAE6OF01CLB0B.21.70.G04.1.454.CMB.1.raw
  modified_base (187)..(187): a, c, t, g, unknown or other
  misc_feature (187)..(187): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtcccctcacctgccacttgtctctggtggctccatcatcaatggtcattanctacgtggggctggactccgccgacgccccgaggggaaggggctgggaggttggggttgacggtagtttagtttttcagtggagttccgggacctaaccttacttagtacgggtcgtcgctacaactgtacgacgtcaacctatacgtccgtagacctaccgtaccacggaacctacgttcctccgtagacgtactacgtaacctctacctcggacccgccgcgaacggtacgtacgggttactaagtttactttagtttcgacggcgtacgaactaggttaaggttacgggttagttacgggtaccttaccgttacccgtacccgtttaacggttaaccgggttagttaccgggtaccggttacgggtaccggggtacccggaacggggacccgcgtaaccggtaccctaaccgttaaccgttcccgacccttaccggtacccctaccccggaaacccgggtacccggtaaccccgtaccggttcccggtttaccccccgttccccggttacccggcccgttcccggtacccggtcccgttacccgagggtacccgacccgtacccggacgtaaccggccggtacccgtaacccggg

SEQ ID NO: 147056 - DNA, 762 bp, Homo sapiens
  misc_feature: GYAE6OF01DUPH9.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgccccgagggaggggctggagtgggtgcgtagttattttcatgagtcggacctacctatagtacggtcgtcgctacaacgagtcgagtccacctatactaccgtagaccacgtccgaaggacctagttcctccctagaacgctacgtactcctcgtcggacccgccgacgacggaccggtacgggttaattacgttaagttacgtttaggtcggtaaccgtaaggtaactacgttaagggttacgggttaggtttacgggtacgttaacccgttacccggtacccgtttaaggtttaacgggttacgttacggggtacggttccgggtacgggggaacccgtaaacggggtacccgtaccgtaccggttaccgtaacccgttcccgtacccgtaccgtaccggtccccttaccccgaacccggtaccgggtcccctaaccggttccccggttaccccttccccccggtcgggtacccccgtccccgtcggtaccccgtacccggaggtaacccgtcccgtaaacccggtcccgaacggaccgcccgtaacccggg

SEQ ID NO: 147057 - DNA, 768 bp, Homo sapiens
  misc_feature: GYAE6OF01CPC89.21.70.G04.1.454.CMB.1.raw
  modified_base (99)..(99): a, c, t, g, unknown or other
  misc_feature (99)..(99): n is a, c, g, or t
  modified_base (558)..(558): a, c, t, g, unknown or other
  misc_feature (558)..(558): n is a, c, g, or t
tcagtcgtcgctcgcacgaccggtgctcgatttagtgtagtgtgaagggaaagggtctccgaagccttcggagaccctgtccctcacctgcactgtctntggtgctccatcatcaatggtcattatcacgtggggctggactccgcccacgcccccgaaggggagggcgtggaggttcggggtgcggtagtttactttttcgagtggagtacgggaccctaacctactagtacggtcgtccgctacgaaccaggtacggactaccaccgtaatacgtcccggtaagaccaccggtacaacggaacctacgttccctacccgtagacgtcgtacgtaccttaccgtcgtaccgaccccggcgcgaacggtaccggtacgggtttaactaatttacgtttaggtttcggtacggaaccgaacggtaacgtaggtttaggttcgggttaacgttacggtaccctaaccgttccgtaccctttaagggttaacgggtagtacggtaccggtcgggtacggggaccgaacgggcgactacggtccctaccgtcctcccgtacnccgtcccgaccgaaccgtaccggtccctaccgtcccggttcccctcccgtccggcccgtcccgtcgtacccgtacgaccggaccctccgaccgtccgaacgccgaccgccggacccgccgggtccggtcggccttcggccggtaacgacccggtagtccccttacgttccctaccgttcgtacccgtcgacggcgtcggcgtgacggtcg

SEQ ID NO: 147058 - DNA, 677 bp, Homo sapiens
  misc_feature: GYAE6OF01CFS8H.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtggggctggatccgccacgcccccgagggaaggggctggagtgggttgcgagtattttcatgatcgggaccactactataggtcgtcgctcaacagtcgagtcaccatatccgtagacacgtccaggaaccagttcctcctagaagctagaactctctcgaccgccgcgagacggcgggtatagttattagttgtgacgagacagtagtgtatggctactcgccttattacggtagtcggacgtcggtcggggaccgaacggggtacccgacgtacggtccctacccggttcctacccgtaccgacgtccctaccccgaaccgaacgggccccctaacgttcccggttccccttccccgtcggccccgtcccgtacgccctaccgaacgggaccacccgtacccgtccggaacggaccgaccgtaccggaccggtcccgggcccgtcggggcctcggtcccgtacgggtaccgaaaccggtccttacccgttacccggacgtacccggacggtacgtcgggaccggtcgggcgtgggacgaccggg

SEQ ID NO: 147059 - DNA, 756 bp, Homo sapiens
  misc_feature: GYAE6OF01CLZNU.21.70.G04.1.454.CMB.1.raw
  modified_base (560)..(560): a, c, t, g, unknown or other
  misc_feature (560)..(560): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtggggctggatccgccacgcccccgaggggaagggctgggaggtgggttgcgtagttatttttcatgagtgggacctacctactagtaggtcgtcgctcaacaggtcgagtcaccatactccgtagacaccgtacaggacctagttcctcctagaacgctagactctctcgcccgcgcgagaccggcggtattatattagttgagcgagacagttaggtggtacgttggaccttacgtccgtacccttaagtacggttagcggtacgtcgtcgggggaccaaacggggcccgacgtacgtcccgtaccggtccttacccgtccgaccggtccccttaacccgaacccggtaaccggggccccctacgtacccggtttccccgtccccccgtacgggccccgtcccgtacggtcccctccggacgggtacnccccgtacccgacccggagcccgaccgaccgtaccggggaccccgggtcccggtcggggtacccttcgggtcccgggttacgggtaccctaaaccggggtaccctttaccccgtttcccccgttacggttacccctaccgttaaccggttccgggaccgggtaccgggggttccacggggtaacccgaaccggggg

SEQ ID NO: 147060 - DNA, 857 bp, Homo sapiens
  misc_feature: GYAE6OF01B5N22.21.70.G04.1.454.CMB.1.raw
  modified_base (234)..(234): a, c, t, g, unknown or other
  misc_feature (234)..(234): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtggggctggatccgccacgcccccgaggggaaggggctggaggtgggttgcgtagttatttttcatgagtcgggaccacctactataggtcgtcgctacaacngtcgagtccacatactccgtagacaccgtaccgaaggaacctacgtttcctaccctaggaacgtcctagaaccttctctcggacccgccgcacggacggtcgggtaatattatttattggcgacgaagactagttaggtaggttactcggactaccgtccgtccttaagttacggtagtacggtacgtcggtacggggaccgtaacggggacccacgtaaacggtccccgtaaacccggttccttacccgtaccgtaccggtaccccccttaaccccgaaaccgggtaaacccggggtcccccctaacggttcccccgggttttacccctttcccccccgggacggtcccccggtcccctacggttcccgaccggtaccgggaccgtacccctaacccggtcccggaaggaaccccgtcgaaacccgggtccgggtaccccgggtcccgggtacggggtccccgttccgggaccccgggtttaccgggttaaacccggtaaaccgggttacccccgtttaccccggttaccccccgtttccggttaacccccgttttaccgtaccggttaccggggacccgggttcccggggtacggttacccggggaaacggtaacccgggg

SEQ ID NO: 147061 - DNA, 668 bp, Homo sapiens
  misc_feature: GYAE6OF01BZ5J8.21.70.G04.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctcgtggtgctccatcatcaatggtcattatcacgtgggctggactccgccacgccccgaggggacgggctgggagtgggtgcgtagtttattttcagtgagtcggacctactactagtaggtcgtcgactacaacagtcgagtccacattacgtcgtacgaccacgtaccaacggtaacctacgtttcctacccgtagaacgtcgtacgtaacctcgtcgtacgacccggccgacgacggacggtacggtaatttattagtttagttcgnggacgagtactaggttagtggttattcggtacctacgttccgtaccgtagtttacggtagtacgggtacgtcgggtacggacgaacgggtcccgacgtacgtcccgtaccgttccgtccctacgaccgtcccctacccgaaccgaaccggccctaccgttcccggtcccgttccccgtacggccctcccgtccggcccttaccggacgggtaccacccgacccgtcgacggtaaccg

SEQ ID NO: 147062 - DNA, 703 bp, Homo sapiens
  misc_feature: GYAE6OF01DLMT5.21.70.G04.1.454.CMB.1.raw
  modified_base (333)..(333): a, c, t, g, unknown or other
  misc_feature (333)..(333): n is a, c, g, or t
  modified_base (648)..(648): a, c, t, g, unknown or other
  misc_feature (648)..(648): n is a, c, g, or t
  modified_base (688)..(688): a, c, t, g, unknown or other
  misc_feature (688)..(688): n is a, c, g, or t
tcagtcgtcgctcgcacgaccggtgctcgatttagtgtagtgtgaagggaaagggtctccgaaggcttcaccagtcctgtcccagctgcagctgcaggagtcggcccaggactggtgaagccttcggagaccctgtccctcacctgcactgtctctggtggctccatcatacaatggtctattatcacgtgggctggactccgccacgcccgaggggaacggggctgggagtgggtgacgtagtttacgttttcatgagtacggaccacgttactagtacggtcgtccgactaccaaacgtagtaccgagtccaacctagtacgttaccgganaccgtacgtaccgaacggtaaccttacgtttacccgtacccgtagaacgtcctaagtaaccgttctcgtaccggacccgccgtaacgaccggaacggtaccggttaattaacgtttacgtttaagttcggtaggacgtaacgacgtaacgttaggttacggttagttcgtactacgttccgtaaccttaacggttacggtacgtcggttacggtacggtcgggacggaacggcgacgtacgtaccgccgttcaccgtacgtacctacccgtacccgaaccggaccggtcccgtagttacccggtcccgttccccncggtcccgtaccgtcgcctacggacgaccgtaccacccgngaacgtcgcgaccgg

SEQ ID NO: 147063 - DNA, 821 bp, Homo sapiens
  misc_feature: GYAE6OF01AVREV.21.70.G04.1.454.CMB.1.raw
tcagtcgtcgctcgcacgaccggtgctcgatttagtgtagtgtgaagggaaagggtctccgaagccttcgggagaccctgtccctcacctgcactgtctctggtggctccatcatcaatggtcattatcacgtggggctggactccgccacggcccccgaggggaaggggctgggagtggggttgcgtagtttatttttcatgagtcgggaccacttactataggtcgtcgctacaacagtcgagtccaccatactccgtaagaccacgtccgaacggaacctacgttccctcccgtagaacgctacgtaacctctcgtacggaccgccgaccgaggaccggtacgggtaattattattagttggtcgacggagtactagtaggttaggttagttcggaccttactccgtacccgttaaggtttacggtacgttacgggtaccgtcggtacgggggaaccgaacgggggtcccgacgaccggttaccctaccccgtcttcccgtcgaccgtacccctaccccgaacccggaaccgggtccccctacggtccccggttccccgttcccccgtccgggccctccccttcggacccgtacccggacggtacccgaccccgtacccgaccggaacgaccggaacccgtacggacccgtccccgggtacccgggtcggacccgttccggtacccgggttacggtaacccggtaaccggttaaccccctttcccgtttaccccccggttcgttacccgttaccggttacccgggtcggggacccggggtacccggggttcgggtaaaccggggcgggtaaccccggg

SEQ ID NO: 147064 - DNA, 895 bp, Homo sapiens
  misc_feature: GYAE6OF01AZDUQ.21.70.G04.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagtgtagtgtgaagggaaaggggtctccgaagccttcggagaccctgtccctcacctgcactgtctctggtggctccatcatcaatggtcattatcactggggctggatccgccagcccccagggagggctggagtgggtncgagtattttcatgatgggaccacctactataggtcgtcgctcaacagtcgagtcaaccatacgtccgtagacaccgtccaaggaacctagttcctacccgtgaacgtctagtaacttctacctcgaccggtccgacgtaacggaccgggtacgggggttaactaacgtttaacgttttaagtttcggttacggaaccgtacggtaaccgtaggttacggttacgggttaacttcggggtaccttaacccgttccgtaaccccgtttaaggttaaccgggttaaacgttcgggtaaccgtttccgggtacggggggtaccctaaaagggggtaccccgtacctaagggttacccgaaacccgggttttccccttaccccgttacgtaacccggtccccctaccccgtaaacccggtaaaccccggggtaccccctaaccgggtttccccgggttaacccctttcccccccggttacggggtacccccgttcccgttaccgtaccccgttaacccggaacgggtacgtaacccgtaaccccgttaccggaaagtacccggactaaaccggccggtccgggtaccccgtggggtaccgttaccggtccggttacggggtaaccggtaaaccggtaacccgtttacccgttcccggttaccttcccgttacccgtaccgggttcgggacccggtccggggtacgtcgggtacccgtaaacgggg

SEQ ID NO: 147065 - DNA, 830 bp, Homo sapiens
  misc_feature: GYAE6OF01C3D8D.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcggccaggacgtggtgaacgtccttcggacgacctgtccctcacctgcactgtctctggtgctccatcatcaagtcggtctattactcgtacggtgggtctacggactcccgccaccgccccggaaggggacgggtcgtgggtaggttgggttaggaccggttaagttttacgttttacgaagttcggacgtaccgggtaaaccttaaccgttacgtaagttaccggtacgtaccgtactaaccgtaaacgtcggttacgtaacgtacctaacctaagttaaccgttaccggtaaacgaccgtaccggtacccgaacggttaaccttcggttccctaccgtacggaactccgtagtacctcgtaccgtcgaccgccgacgacgtaccggtacggttaatactttaacgttgtagacgtacgaaacgtctaagggttcgttacgtacgttcgtaccgtcgttccgttaaccgttaaggttacggttcgtaacgggccgtttacgggaccgggtacggaaccgggtcgtacgtaaccgggttccaacccggttccgtaccgttaccgacccgtaccgttaacccgggaaaccggaccggttcccgtaaacccgtttcccgggcccccttttccggaacccgggtccctaaccccgggttcgtacccgtacccgggaccgttaacgtacccccgttaaaccgcgttaacccggccgtacgttaaccccgggg

SEQ ID NO: 147066 - DNA, 839 bp, Homo sapiens
  misc_feature: GYAE6OF01D2X5E.21.70.G04.1.454.CMB.1.raw
  modified_base (126)..(126): a, c, t, g, unknown or other
  misc_feature (126)..(126): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatgtctattanctacgtgggctaggctcccgaccaccgacccccggaagggggaaggggtcgtagggaggttggggttgcgtagtttattttcgagtgagtcggacccaccttactagtacggttccgtccgctacaacgtgtacgtactacaacctattacgtccgtaacgacctaccgtaccgaaggtaccttacgttccctacccgtaggaacgtcctacgtaaccttcctcgtacccgacccgccgacaggacggtacggtaattattattttagtggtcgacgtaagactagttaggttacggttgtcgtacctaccgtccgttacctttaaggttacggtaggtacggaccggttggtaccggggaccgtaacgggcccgacgtaccgtacccgtacccgttcctacccgaccgaccctccccgtaacccgaacccggacccgggtaccccgttaccgttcccggtttccccgttaccccccggtccggaccccgtccccgtccgtacccggtaccccggaacggtaccgacccccgttacccgaacccggtaaccgaccgtaccgacccggaccgggccccggttcccggtaccgggtccgtcccggtcggtaccggttaacccgtaacccggttaccccctttacccgttccccgttcccttcccgtttaaccctccggtacgggaccggtcggtaccggtcggacggtacccggg

SEQ ID NO: 147067 - DNA, 764 bp, Homo sapiens
  misc_feature: GYAE6OF01AVEU1.21.70.G04.1.454.CMB.1.raw
  modified_base (574)..(574): a, c, t, g, unknown or other
  misc_feature (574)..(574): n is a, c, g, or t
tcagtcgtcgctcgcacgaccggtgctcgatttagtgtagtgtgaagggaaagggtctccgaaggcttcaccggtcctgtcccagctgcagctgcaggagtcgggcccaggactgggtgaagccttcggagaccctcgtcctcacctgcactgtctcgtggtggctccatcatacgaatcggtactattatccacgttggggctaggactccgaccgacgccccggaaggggaaggggcgtagggaggtgggttgcgtaagtttattttacgatgagtacggacctacgtagtacgtacggtcgtcgctacgaacgtagtacgacgacctacgtactacgtccggtacgaaccgtaccgtaccgaaacggtaacctacgttcctccgtaagacgtcctagtaacctctacgtcggacccgcggacaacggacggtacggtaataacttagttagtgtacggcgtaagtactaagttacggttagtacgttaggtacctacgttccgtaccccgtttaaggttacggttacggtccggtaccgggttacggcggggtaaccggaacgggtaccgngtaccggtccgtaacccgttccgtaccctaccggtaaccgtcccgtaacccgaaccggtaaccggtccccgtaccggttccccgggtttacccctccccgaccggtcccgtacccgtcgtacccgtaccggtaccgggaccttacccggtaccccgaccgggaaggcccgaaaccgccgggtaccccggg

SEQ ID NO: 147068 - DNA, 800 bp, Homo sapiens
  misc_feature: GYAE6OF01BL8T0.21.70.G04.1.454.CMB.1.raw
  modified_base (558)..(558): a, c, t, g, unknown or other
  misc_feature (558)..(558): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcacgtggggctggactccgccacgcccccgagggaagggctggagtcgggtgcgtagttatttttcatggagtcgggaaccctaccgtacttacgtacgggtccgtcgcctacgaacgtacggtacgtacgtaccgaacctaagttacgtacccgtaagtacctaaccggtaccgaacggggtaaaccctggtttaccctacccgtaggtaaacgtccgtagaaccttccgtacgtcggaccccgcccgacgacggaccggtcgggtttaattagtttacgttacgttggtacgtaccggaagtaacttaaggtacggtttaggttacgttaccggccttaccgtccgtacccgtttagttaccggtaagtcggtaacgtcgggtaccgggaccgtacggggacctcgtacgtacccgtacctcgtcctacnccgtaccctaccgaacccgacgggtaccctacggtttcccggtcccctcccggtaccggtcccgtacccgttcgcccgttaccggacgggtaaccgtccccgtacgtaacgggactaccgcgtaaacccggtccggccggtcccggtaggcctaccgggtccgttacggaccgtaaccgttccttaccccgtccgttaccctcgttacctacggcggtaccggccgttacgtcggcgtacgg

SEQ ID NO: 147069 - DNA, 1020 bp, Homo sapiens
  misc_feature: GYAE6OF01CJZRR.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtccgggcccaggacgtggtgaagccttcggacgaccctgtcccctcacctgcactgtctcgtggtggctccatcatacaagtggtactattatctacggtgggctggactcccgaccgaccggaccccggaggggtaacgggcgtagggaggttgggttgacggtagtttactttttacgagtgtacgtacgggacctaacttacgtagtacggtcgtacgactacgaacgtaggtaccgacgtaccaacctaagtaccgttaccggtaacgaccgtaaccggtacccgaacggtaaccctacgttcctacccggtagtaaccgtcgtaacggtaaccttctaccgttaccggacccggtaccgacggtaaccgggaacggtaccggttaaattaagtttaatttacggttacggtcggtaaaccgacggttaacgtacgggttaacggtttacggtttaacggttcgggtaacccttaacccggttaccccggttacccgtttaaacgggttaaaccggggtttacggtttaccgggggtaaccggttttaccggggtaccggggggtaaacccgggtaaaccgggggacccgtaacccgggttaaaccggtttacccccgggttaaacccgtttcccggtttaaccccccggttaccgttaaccccgggaaccccccggtttaaacccccggtaaaccccgggtaaaacccggggtacccccgtttaccccggggttttaacccccgtttccccccccgggtttacccccccgggttaaccccggggttccccccgttaccccccgggtttacccggttacccccgtaaccccggggtaaaccggtaccccgggttaaccccggaaccccgggttaaccccggaccggtttaaacccgacccgggtaaacccccgggg

SEQ ID NO: 147070 - DNA, 937 bp, Homo sapiens
  misc_feature: GYAE6OF01DFHYP.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccagggactggtgaagccttcggacgaccctgtcccctcacctgcactgtctcgtggtgctccatcatctaagtggtactattactacgtacgtggggcgtaggacgtcccgaccgaccggacccccgggaagggggaacgggggtcggtggggtacgggttggggttcggacggttaggttttactttttacgagttaggtacggtaccgggaacccgttaacccgttaacgttaaggttacggttaccggttaccggacctaaccgtaaacgtacggtacggtaacgttaccaaccgtagttaaccggtaccgtaacgaaccgtaccgtaaccgaaccggtaaccttacggttaccctaccgtagaacgtctaacggtactaccgttccgtcggacccgccgacgacggacggtacggttaataagtttaacgttacgttggtacggacgtaacggtacttaagggttaggttaggtttacggttacgttaccgttacccgttacccgttaccgtttaacgggtttaccggttagggttaccggggttacccggttaccggggttaccgggggaaccggtaaccgggggacccaccgggttaaccgttacccggtaacccgtttccgtaacccgttaccgaccccggtaccccgtaacccgtaaaccccgggtaccgggtaccccgttacccggtttccccggttacccccggttccccgcccgggggttaccccctcccggttacccggtaccccgaaaccgggtacgggaccccgtaccccgtaaccccgggtaccgaaacggtaccccggaccgtaaaccccgggg

SEQ ID NO: 147071 - DNA, 899 bp, Homo sapiens
  misc_feature: GYAE6OF01EQP9V.21.70.G04.1.454.CMB.1.raw
tcagtcgtcgctcgcacgaccggtgctcgatttagtgtagtgtgaagggaaagggtctccgaaggcttcaccagtcctgggtcctgtcccagctgcagctgcaggagtcgggcccagactggtagagccttcggagaccctgtccctcaccgtgcactgtctcgtggtcgcctcatcatcaatggtactattactcgtacgtcgggctggacgtcccgaccgacgaccccggaggggacgggcgtaggaggttgggttcgtacgtacgtttagttttcgatggtacgtcggtaccctacgtaacgttagtacggtccgtacgctaccgaagtacggtcgtacgtaccaactattacgtaccgtaacaccgtaccgaccaacggaccttacgtcctaccgtagacgtcgtacgtacctctcgtacggacccgtccgacgaccggtaccgggttacggttaatttaagttacgttttaggtacgggtacggtaacggtaaccggtaagttaacggtttaacgggttagggtttacggttaccggggttacctttaccggttaccccggttaccggtttaaacggtttacgggtacgggttaccgggttaaccggtccgggtaccggggtaacccggaacggggtacccgtaccgggtaaccggttaaccccgttaccccggttacccgttaccccgtaccggtaacccccggttaccccgtaaaccccccggaaccccggggtaaccccggttacccccggttaaccccgggtcccccggtttttcccccggttcccccccggtcggggttaccccccgtacccggttccccgtaaccccggtacccggtacggggtaaccccctcccggtaacccggtcccgggaacggttaaccccggg

SEQ ID NO: 147072 - DNA, 752 bp, Homo sapiens
  misc_feature: GYAE6OF01D14X6.21.70.G04.1.454.CMB.1.raw
tcagtcgtcgctcgcacgaccggtgctcgatttagtgtagtgtgaagggaaagggtctccgaagccttcggagaccctgtccctcacctgcactgtctcgtggtcggctccatcatcaatggtcattatcacgtgggctggactccgccacgccccgagggagggcgtggaggtgggttgcgtagtttattttcagtgacgtcggacctacctactagtacggtccgtcgctacaacgtacgtcgacgtcaacctatacgtaccgtagacctaccgtaccaacggtaacctacgttcctacccgtagaacgtctagaaccttctccgtcgaccccgcgtacgaggaccggtacggttaattagtttactttagtcgtgacgagaactgtaggttgtactggtacctacgtccgtccttagttacgtgtcggtacggtcgtacggggacaacgggccgtcgtacgtccgccgttctccacgtaccgtccctaacccgaccgaaccggtaccctacgttcccggtccccttccccgcggtcccgtcccgtccgccgtaccgacgccgtacccgccgtaccgaacgtccgacccgtacgacccgggtccggtaccggtccgggtaccgtccgggtaccggtaccggttaaccggaaacccgttacccggttaccccggttacccggaccgggtacccggaaaccggtaccggtaacggggcccgggccgggtaccggttagggaccggtaaccgg

SEQ ID NO: 147073 - DNA, 526 bp, Homo sapiens
  misc_feature: GYAE6OF02FR08B.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaagggcccatcggtcttcccctggcgccctgctccaggacgcacctccgagacgcacagcggccctgggctgcctggtcaaggctacttcccgagccgacgactgagcgggctggcaacgg

SEQ ID NO: 147074 - DNA, 568 bp, Homo sapiens
  misc_feature: GYAE6OF02IZY4Y.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtatggctactcgccctattacggtatggacgtctggggccaagggccgcagtcaccgtctcctcagcctcaccaacgggcccagtccggtcttccccctggccgccctcgcctcccacggcgccaccctccggagacgccaaccgacgccggccccgtgggccctgccctcgggtcaaacgggtacctaccgttccccgaggccgaccgacctcggacgccgggcctgggccgaacggg

SEQ ID NO: 147075 - DNA, 552 bp, Homo sapiens
  misc_feature: GYAE6OF02F93JO.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggccgcagtcaccgtctcctcagcctccaccaacgggcccatccggtccttcccccgtcggccgccctcgcctccgacggacgccacctccgacgacgccacacgccggccctcgggcctcgcctggtccaacggacctaccttccctcgtcctcctactcgacgcgggctcggcacgg

SEQ ID NO: 147076 - DNA, 569 bp, Homo sapiens
  misc_feature: GYAE6OF02GQX63.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttcctccctgaagctgaactctctgaccgccgcagacgcgggtatatattattgtgcgagacatagtggtattggctactcgccctattacggtatggacgtcgtggggccaaggggccgcagtccaccgtctcctcacgcctccaccaacgggcccactccggtccttcccccgtcggccgccctcgcctcccgaggacgccacccgtccgagacgcaccgacgccggccctgggcctcgcccttgggtccaacgggaccttaccgttccctcgttcctcctacgtggacgcgggctggcaacggg

SEQ ID NO: 147077 - DNA, 549 bp, Homo sapiens
  misc_feature: GYAE6OF02HJASW.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggacacctactataggtcgtcgctcaacagtcgagtcaccatatccgtagacacgtccaggaaccagttctccctgaagctgaactctctgaccgccgcagacgcgggtatagtattattgtgcgagacatagtggtattggctactcgccctattacggtatggacgtcgtggggccaagggacgcagtcaccgtctcctcagcctccaccaaggcccaatccggtaccttcccccgtcggccgtccccgtcgcccttcccgacggacgccgtaccctcccggacgtacgaccaaccgg

SEQ ID NO: 147078 - DNA, 548 bp, Homo sapiens
  misc_feature: GYAE6OF02I6IDA.21.70.G04.1.454.CMB.1.raw
  modified_base (380)..(380): a, c, t, g, unknown or other
  misc_feature (380)..(380): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagaccacgtccaggaaccagttctccctgaagctgaactctctgaccgccgcagacgcgggtatatattattgtgcgagacatagtggtattggctactcgccctatacggtatggacgtctggggccaaggggccncagtcaccgtctcctcacgcctccaccaagggcccatcggtccttccccctggccgccctgcctccaggacgccacctccgacgacgccacgacgccggccctcgggctcgcctggtccaacggactaccttccctcgtcctctactcggacgcgggctggcaacggg

SEQ ID NO: 147079 - DNA, 539 bp, Homo sapiens
  misc_feature: GYAE6OF02H5WZP.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccactactataggtcgtcgctcaacagtcgagtcaccatatccgtagacacgtccaggaaccagttctccctgaagctgaactctctgaccgccgcagacgcgggtatatattattgtgcagggacatagtggtattggctactcgccctattacggtatggacgtctggggccaagggaccgcagtcaccgtctcctcacgcctccaccaacgggcccatcggtccttcccctcggccgccctcgcctccaggacgccaccctccgacgagccacacgccggcccgtgggctgccctggtcaggactaccttcctccgtctctctcgagcgggctggcacgg

SEQ ID NO: 147080 - DNA, 536 bp, Homo sapiens
  misc_feature: GYAE6OF02JDOYS.21.70.G04.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttcnccctgaagctgaactctctgaccgccgcagacgcgggtatatattattgtgcgagacatagtggtattggctactcgcctattacggtatggacgtcgtggggccaagggacccgcacgtccaccgtctcctcacgccctccaccaacgggcccagtccggtccttccccgtggcccgccctgcctccgaggacgccaccctccgagacgcaacg

SEQ ID NO: 147081 - DNA, 558 bp, Homo sapiens
  misc_feature: GYAE6OF02GFQEC.21.70.G04.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaaggggacccgnagtcaccgtctcctcacgcctccaccaacgggcccagtccggtccttccccctcggccgccctcgcctcccgaggacgccaccctccgacgacgccacgacgccggccctcgggctcgccctggtccaacggcctaccttccctcgttcctctactcgacgcgggctggcaacgg

SEQ ID NO: 147082 - DNA, 594 bp, Homo sapiens
  misc_feature: GYAE6OF02I3Q3A.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgccctatacggtatggacgtctggggccaagggcccgcagtccaccgtctcctcacgcctccaaccgaacgggcccatccggttccttcccccgtcggccgccctcgcctcccgaggtacgccacctccggacgacgccacgacgccggcccgtgggcctcggcccttgggacctaacgggaccttaaccgtttccccgtaccgttccttaccgtaaccgttggaccggtccggggccttcgggactaacggg

SEQ ID NO: 147083 - DNA, 530 bp, Homo sapiens
  misc_feature: GYAE6OF02FQO7C.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgttctggggccaagggaccgcagtcaccgtctcctcagcctccaccaacggcccatccggtcttcccctcggccgccctcgcctccacggacgcacctcccgagacgcaccg

SEQ ID NO: 147084 - DNA, 589 bp, Homo sapiens
  misc_feature: GYAE6OF02JO26H.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtggtattggctactcgccctattacggtatggacgtctggggccaagggccgcagtcaccgtctcctcacgcctccaccaacgggcccactcggtccttcccccgtggccgccctcgcctccgacggacgccacctccgacgacgccgacacgccggcccgtgggcctcggccgtcggtaccgaacgggtacccttaccgtttccccgtaccgttccttaccgttaacgttcggaacgtccggggcgttcgggccgtaacggg

SEQ ID NO: 147085 - DNA, 531 bp, Homo sapiens
  misc_feature: GYAE6OF02ID3NR.21.70.G04.1.454.CMB.1.raw
  modified_base (329)..(329): a, c, t, g, unknown or other
  misc_feature (329)..(329): n is a, c, g, or t
  modified_base (476)..(476): a, c, t, g, unknown or other
  misc_feature (476)..(476): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttcnccctgaagctgaactctctgaccgccgcagacgcggtatatattatgtgcgagacatagtgtattggctactcgccctattacggtatggacgtctggggccaacgggccgcgagtccaccgtctcctcacgcctccacacggcccngtccggtccttccccgtggccgtccctgcctccgacggcgccaccgtccgagacg

SEQ ID NO: 147086 - DNA, 594 bp, Homo sapiens
  misc_feature: GYAE6OF02IB98Q.21.70.G04.1.454.CMB.1.raw
  modified_base (379)..(379): a, c, t, g, unknown or other
  misc_feature (379)..(379): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagccccccagggaaggggctggagtgggttgcgagtatttttcatgatgggaccactactataggtcgtcgctcaacagtcgagtcaccatatccgtagacacgtcaggaaccagttctccctgaagctgaactctctgaccgccgcagacgcggtatatattattgtgcgagacatagtggtattggctactcgccctattacggtatggacgtctggggaccaagggaccncagtcacgtctcctcagcctccaccaacgggcccacgtccggtccttcccccgtggccgtccctcgcctcccgaggacgccaccgtccgacgacgccacacggccggcccgtgggcctcgcccgtgggtccgaacgggtaaccttaccgtttaccccggacggtacccggaaccggaccgtacgggacgggaccggggccgtcgggacgaacggg

SEQ ID NO: 147087 - DNA, 575 bp, Homo sapiens
  misc_feature: GYAE6OF02J2C5H.21.70.G04.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagtcgtcgctcgcacgaccggtgctcgatttagtgtagtgtgaagggaaagggtcgtccgaaggcttcaccagtcctgtcccagctgcagctgcaggagtcgggcccaggactggtgaagccttcggagaccctgtccctcacctgcactgtctctggtggctccatcatcaatggtcattatcactgggctggatcgcagccccaggaagggctggagtgggttgcgagtagtttttcatgatgggaccacctactataggtcgtcgctcaacagtcgagtcacatanccgtanacacgtccaggaaccagttctcctgaagctagaactctactgaccgccgcagacgcgggtaatatattattgtgtcgagacatagtgtattggctactcgccctaattacggtatggacgttcgtcggggaccaacggggtaccgcgacgttcgaaccgttccgtacctcgaacgcccgttaccaaccgaacgggcccaagtcccggtccttccccgtcggccgaccctggcctccgtacggacgtccgaacccgtccggacgtaccggcctaaccgg

SEQ ID NO: 147088 - DNA, 584 bp, Homo sapiens
  misc_feature: GYAE6OF02G6D7L.21.70.G04.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtcaggaaccagttctcctgaagctagaactctctgaccgccgcagacgcgggtatatattattgtgcgagacatagtgtattggctactcgccttattacggtatggacgtcgtggggccaagggaccncgagtccaccgtctcctcacgcctccaaccgaacgggccctaagtccggtccttcccccgtcggccgtcccgtgccctccgaacggcgccacctccggagtacgaccaccgacgccgggcccgtgggacctcgacccgtgggtaccaacgggtccttacccgttccctcgttcctcgtacgtcggacggccgggctcggacacggg

SEQ ID NO: 147089 - DNA, 550 bp, Homo sapiens
  misc_feature: GYAE6OF02JCPCG.21.70.G04.1.454.CMB.1.raw
  modified_base (520)..(520): a, c, t, g, unknown or other
  misc_feature (520)..(520): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggtgcgagtattttcatgatggaccactactataggtctcgctcaacagtcgagtcaccatatccgtagatacgtccaggaaccagttctccctgaacgctgaactctctcgaccgccgcagacgcgggtaatatattattgtgcgagacatagtgtaattggctactcgtcctattacggtatggacgtctggggccaagggaccgcacgtcaaccggtcctccgtcacgcctccgaccaacgggcccagtccggtccttacccccgtcggtcccgccctcgcctacccgnggacgccaccgtaccgagtacgccaaccgg

SEQ ID NO: 147090 - DNA, 537 bp, Homo sapiens
  misc_feature: GYAE6OF02F1JKC.21.70.G04.1.454.CMB.1.raw
  modified_base (454)..(454): a, c, t, g, unknown or other
  misc_feature (454)..(454): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggacccgcagtcacccgtctcctcagccctccaccaagggcccatccggtccttccccctggccgccctgcctccacggcnccaccctccgagacgcacacgccggccctgggctgcctggcaaggctacttccctcgtctctactgacgcgggctcggcacgg

SEQ ID NO: 147091 - DNA, 630 bp, Homo sapiens
  misc_feature: GYAE6OF02IXSQE.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttcctccctgaagctgaacctctctgaccgccgcagacgcgggtatatattattgtgcgagacatagtggtattggctactcgccctattacggtatggacgtcgtggggccaaggggcccgcacggtcacccgtctcctcacgcctccaccaacgggcccagtccggtccttccccgtcggccgccctgcctccgaggacgccacccgtccgacgacgaccacgacggcccggcccgtcgggcctcgtcccgttcgggtaccgtaaacgggtaacccgttaacccgtttccccgttacccggttaccgttccgttaaccgttcgggtaaccggtcccgggggtaccgttcggggtacgaaaccgggg

SEQ ID NO: 147092 - DNA, 629 bp, Homo sapiens
  misc_feature: GYAE6OF02GEOH3.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtgtattggctactcgccctattacggtatggacgtctggggccaagggccgcagtcaccgtctcctcacgccctccaccaacgggccccaagtccggtaccttcccccgtcggccgtcccctcgcctcccgaacgggacgcccgacccttccggacgacgaccaccgaacggccgggcccctcggggcctcggcccgttacgggtaccgaaacgggtaccttaccgtttcccccgtccggtttcccttaccgttaaccgtcggtaaccgggtccggggccgttacggggaccgtaaccgggg

SEQ ID NO: 147093 - DNA, 514 bp, Homo sapiens
  misc_feature: GYAE6OF02ISNOY.21.70.G04.1.454.CMB.1.raw
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagtcgtcgctcgcacgaccggtgctcgatttagtgtagtgtgaagggaaagggtctccgaagccttcggagaccctgtccctcacctgcactgtctctggtggctccatcattaatggtcattatcactggggctggatccgccagcccccagggaagggggctggagtgggttgcgagtattttcatgatgggaccacctactataggtcgtcgctcaacagtcgagtcaccatatccgtagacacgtccaggaaccagttctccctgaagctgaactctctgacccgcgcagacgcgggtatatattatgtgcgagacatagtgtattggctactcgccctattacggatggacgtctggggccaagggccncagtcaccgtctctcagcctcacaaggccatcgtcttccccngccgcctgctccagcnccacctcgagacgcacagtcgcctgggctgcctggtcaaggactacttccctgtcctctactcgcgcggctcggcaggcg

SEQ ID NO: 147094 - DNA, 577 bp, Homo sapiens
  misc_feature: GYAE6OF02HQH3D.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaacgctgaactctctcgaccgccgcagacgcgggtactatattattgtgcgagacatagtggtatggtctactcgtccctagttacggtagtggtacgtcgttggggaccgaagggaccgcacggtcaccgtcctcctcgacgcctaccaaccgaagggcccagttccggtaccctttcccccgtcgggtcccgccccgtcgtcccgtacccgacggacgccgacccgttcccggaacgtcgaccaaccgg

SEQ ID NO: 147095 - DNA, 548 bp, Homo sapiens
  misc_feature: GYAE6OF02GOR76.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagaccgcgggtatatattatgtgcgagacatagtggtattggctactcgccctattacggtatggacgtctggggccaaggggccgcagtccaccgtctcctcacgcctccaccacggcccactcggtccttcccccgtcggccgtccctgcctcccgaggacgccaccctccggacgacgcaccgagccggccctgggctcgcctggtcaggacctacttccctcgttcctctactgacgcggctggcgacgg

SEQ ID NO: 147096 - DNA, 572 bp, Homo sapiens
  misc_feature: GYAE6OF02GJBT5.21.70.G04.1.454.CMB.1.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagcccccagggaagggctggagtgggttgcgagtattttcatgatgggaccacctactataggtcgtcgctcaacagtcgagtcaccatatccgtagacacgtccaggaccagttcnccctnaagctgaactctctgaccgcgcagacgcgggtatatattattgtgcgagacatagtggtattggctactcgccctattacggtatggacgttcgtggggccaagggccgcagtcaccgtctcctcacgcctaccaccaaacgggccccaagttccggtccctttccccccgtgggtcccgtacccccgttcggcccgttcccgagggaccgccgtaaccccgttcccggaacggtacgcctaacccgg

SEQ ID NO: 147097 - DNA, 547 bp, Homo sapiens
  misc_feature: GYAE6OF02IMURA.21.70.G04.1.454.CMB.1.raw
  modified_base (319)..(319): a, c, t, g, unknown or other
  misc_feature (319)..(319): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctcatcatcaatggtcattatcactggggctggatccgccacgcccccagggaagggctggagtgggttgcgagttattttcatgatggaccacctactataggtcgtcgctcaacagtcgagtcaccatatccgtagacacgtcaggaccagttcncctganctgaactctctgaccgcgcngacgcggtatatattattgtgcgagacatagtggtattgctactcgtcctattacggtatggacgttcgtggggccaagggaccgcaggtcaccgtactcctcacgtccctaccaaccgaacgggcccaacgttccggtacccttcccccgtggcccgtcccgtcgcctccgaaggcgccgaccgtccggacgacgcaccgg

SEQ ID NO: 147098 - DNA, 586 bp, Homo sapiens
  misc_feature: GYAE6OF02GU00F.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctgggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgtcctattacggtatggacgttcgtcggggccaaggggcccgcgagtccaccggtactccctcgacgcccttaccacccgaaacgggccccaacgttccggttaccctttccccccgtcgggtcccgtccccctcggcccttcccggacggacgcccgacccgttcccggacgtacgccaacccgg

SEQ ID NO: 147099 - DNA, 587 bp, Homo sapiens
  misc_feature: GYAE6OF02GGT5V.21.70.G04.1.454.CMB.1.raw
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtattttcatgatgggaccacctactataggtcgtcgctcaacngtcgagtcacatatccgtagacacgtccaggaaccngttctcctgaagctagaactctctgaccgccgcagacggcgggtatactattagttgtagcganacataggtagtattggctactcgaccctagttacggtatggacgttcgtggggccctaaaggggacccgtacacgtcgacccgtacttccctcaacggccctaccgacccgaacgggtccccgagtacccggttcctttcccccgtcgggtcccgaccccttcggccttcccgacggtacgccaacccgtccgacgacgtacaacccgg

SEQ ID NO: 147100 - DNA, 518 bp, Homo sapiens
  misc_feature: GYAE6OF02F33K8.21.70.G04.1.454.CMB.1.raw
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
  modified_base (499)..(499): a, c, t, g, unknown or other
  misc_feature (499)..(499): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggccgcagtcaccgtctccncagcctccaccaggcccatcgtctcccctggcnccctgcctccaggacncgacctcgacgacgcaccg

SEQ ID NO: 147101 - DNA, 669 bp, Homo sapiens
  misc_feature: GYAE6OF02ILRX9.21.70.G04.1.454.CMB.1.raw
  modified_base (336)..(336): a, c, t, g, unknown or other
  misc_feature (336)..(336): n is a, c, g, or t
  modified_base (382)..(382): a, c, t, g, unknown or other
  misc_feature (382)..(382): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtagacacgtccaggaaccagttctccctgaacgctgaactctctgaccgccgcagacgcgggtatatattatgtgcgagacatagtggtattggntactcgcctattacgtatggacgttcgtggggaccaagggacccgnacggtccaccgttcctccctcacgtccctccaacccgaacgggccctaagttccggtccctttcccccgtcggccgccccgtgcctccgaggtacgccaccgtccggaagacgccacgacggacccggtcccgtacgggccgttacgcccgttacgggtaccgtaaacggggtaacccctttaacccggtttcccccgttacccgggtttacccttacccggtttaaccgttacgggtaaccggggtcccggggtaccgtttaccgggggacccgtaaacccggggg

SEQ ID NO: 147102 - DNA, 595 bp, Homo sapiens
  misc_feature: GYAE6OF02JUFN7.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcggacccaggactggtgaagccttcggagaccctgtccctcacctgcactgtctctggtgctccatcatcaatggtcattatcactgggctggactccgccagcccccagggaaggggctggagtgggttgcgagtattttcattgatgggaccacctactataggtcgtcgctcaacagtcagtcaccatatccgtagaccacgtccaggaaccagttcctccgtgaagctgaactctctgaccgccgcacgacggcggtactagtaattattcgtgacgatactagtagtgtattggctactccgtcctaattacggtatgggtacgttcgtaggggaccaagggaccgtcaaggtccaccgttcctaccttcgaccgtacccttaccgaaccgaacgggtccccagttaccggtccttacccccgtcgggtccctccccgtgtcccctcgtaccggagtccctaacccgtcccggaagtacgacccaccgg

SEQ ID NO: 147103 - DNA, 620 bp, Homo sapiens
  misc_feature: GYAE6OF02HTHZF.21.70.G04.1.454.CMB.1.raw
  modified_base (283)..(283): a, c, t, g, unknown or other
  misc_feature (283)..(283): n is a, c, g, or t
  modified_base (484)..(484): a, c, t, g, unknown or other
  misc_feature (484)..(484): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccagggaaggggctggagtgggttgcgagtatttttcatgatgggaccacctactagtaggtcgtcgctcaacngtcgagtcaccatactccgtagacacgtccaggaacctagttcctcccgtagaacgtctagaaccttctctcgacccgccgacacgacggcgggtaatattattattgtgcgaagactatagtggtattggctactcgtaccttagttacggtatggacgttcgtggggaccaagggaccgcgacgtcacccgtctcctcncgtccctaccaccgaacggcccctagtcccggttcccgttcccccgtcgggtcccgtacccccgttcggccccttacccggacgggaccgtaccccgaaccccgttaccccgggaacgtaccggacccgaacccgg

SEQ ID NO: 147104 - DNA, 560 bp, Homo sapiens
  misc_feature: GYAE6OF02GE0EC.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaagctagaactctctgaccgccgcagacgcgggtatatatttattgtgcgagacatagtgtattggctacgtcgcctattacggtatggtacgtcgtggggccaacgggccgcacggtcaccgttctcctcgacgccctccaccgaacgggcccacgttcccggttcccttcccccgtacgggcccgtccctcgccctccgacggacgccacccgtccgacggacgccaaccgg

SEQ ID NO: 147105 - DNA, 530 bp, Homo sapiens
  misc_feature: GYAE6OF02ITQR4.21.70.G04.1.454.CMB.1.raw
  modified_base (339)..(339): a, c, t, g, unknown or other
  misc_feature (339)..(339): n is a, c, g, or t
  modified_base (378)..(378): a, c, t, g, unknown or other
  misc_feature (378)..(378): n is a, c, g, or t
  modified_base (426)..(426): a, c, t, g, unknown or other
  misc_feature (426)..(426): n is a, c, g, or t
  modified_base (525)..(525): a, c, t, g, unknown or other
  misc_feature (525)..(525): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtccacatatccgtagacacgtcaggaaccagttctccctgaagctgaactctctgaccgcgcaggacgcggtatatattatgtgcgagacatagtggtaattggctacncgccctattaacgatcggacgtcgtgggccaagggaccnagtcaccgtctcctcacgcctcaccaaggccatccggtctccctgccncctcgctccagacgcaccgtccgagacgcgaacacggccgccgtggcctgcctggtacaacggactaccttccctcgtctctactgacgcggctacggnaacgg

SEQ ID NO: 147106 - DNA, 579 bp, Homo sapiens
  misc_feature: GYAE6OF02HAS4D.21.70.G04.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattatgtgcgagacatagtggtattggctactcgcctattacgtatggactcgtggggccaaggggccnagtccaccgtctcctcacgcctaccaccaacgggcccagtccggtccttccccctggcccgtccctcgcctccgaggacgccacccgtccgacgacgcaccgacgccggcccgtgggcctcgcccgtgggtccgaacggacccttaccgttcccgtcgttccttaccgtacgttcggacggccgggtctcggacgaaccggg

SEQ ID NO: 147107 - DNA, 642 bp, Homo sapiens
  misc_feature: GYAE6OF02HZFMF.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctgggagtgggttgcgagtatttttcatgatgggaccactactataggtcgtcgctcaacagtcgagtcaccatatccgtagacacgtccaggaaccagttctcctgaagctgaactctctgaccgccgcagacgcggtatatattatgtgcgagacatagtggtattggctactcgacccttagttacggtatcggacgttcgtcgggggaccaaggggacccgcgaacggtccaacccgttcctaccctcacggtccctcccaacccgaacgggaccccacgtccgggttccctttccccccggtggcccgtccccgtgccctacccgaagggacgcccacccgtaccgacggacgaccaaccgacggtcccgggcccgtggggcctcggcccgttacgggtccaacgggtacctttacccgttcccctcgttccctcgttaccgtcggacggtccggggcctgggaccgaacggg

SEQ ID NO: 147108 - DNA, 574 bp, Homo sapiens
  misc_feature: GYAE6OF02GY7EP.21.70.G04.1.454.CMB.1.raw
  modified_base (551)..(551): a, c, t, g, unknown or other
  misc_feature (551)..(551): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagccccagggaaggggctggagtgggttgcgagtattttcatgatgggaccactactataggtcgtcgctcaacagtcgagtcaccatatccgtagacacgtccaggaacctagttcctccctgaacgctagaacctctctgaccgtccgcagacgcgggtatatattatgtgcgagacatagtgtatggtctactcgcctatacggtatcggacgtgtcggggacctaagggaccgcgacgtaccaccgtcctacccgtcacgcctcccaaccgacggccctacgttccggtacccgttcccccgtcggcccgtcccgtcgtccgtacccgacggtaccncccgtaccgtcccggacgaccgg

SEQ ID NO: 147109 - DNA, 607 bp, Homo sapiens
  misc_feature: GYAE6OF02IKAW8.21.70.G04.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtgctccatcatcaatggtcattatcacgtgggctggatccgccacgccccgagggaagggctggagtgggttgcggtagttattttcatgagtcgggaccactactataggtcgtcgctcaacngtcgagtcacatatccgtagacacgtccaggaaccagttcctcctagaacgctagaactctactcgaccgccgcaagcgacgggtatagttaattatgtgcgagacagtagtggttatggcttacgtcgcccttaagttaccggtagttcggacggtcgtaggggaccaacgggaccgcacggtccacccgtctccctacgacgtccctaccaacccgacgggtccctacgttcccggttacccttcccccggtcggccccgtcccgtcgtccccgttaccgacgggtaccacccgacccgttcccggagaacccgg

SEQ ID NO: 147110 - DNA, 560 bp, Homo sapiens
  misc_feature: GYAE6OF02GND5D.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggccgcagtcaccgtctcctcagcctccaccaacgggcccagtccggtccttcccccgtggccgccctcgcctccaggacgcaccctccgagacgcacacgccggcccgtgggcctcgccgtggtccgaacggtccttaccttcccctcgttcctctaccgtcggacgcgggctcggcgtaacggg

SEQ ID NO: 147111 - DNA, 611 bp, Homo sapiens
  misc_feature: GYAE6OF02JVHN9.21.70.G04.1.454.CMB.1.raw
  modified_base (363)..(363): a, c, t, g, unknown or other
  misc_feature (363)..(363): n is a, c, g, or t
  modified_base (433)..(433): a, c, t, g, unknown or other
  misc_feature (433)..(433): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccttatacggtatggacgtntggggccaaggggaccgcgtagtcaccggtctcctcacgcctccaccacggcccatcggtccttaccccnggcctccctgcctcccaggacgccacctccgacgacgacgaccgaggccgccccgtaggggcctacggcccgtacgggtccgaaaccgggtaccttaacccgtttccccgttcccggttacccgttaccgttaccgtcggtacggtacccggggccgttacgggacccgtaaccgggg

SEQ ID NO: 147112 - DNA, 528 bp, Homo sapiens
  misc_feature: GYAE6OF02F1HUS.21.70.G04.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccactactataggtcgtcgctcaacagtcgagtcaccatatccgtagacacgtccaggaaccagttcnccctgaagctgaactctctgaccgccgcagacgcgggtatatattattgtgcgagacatagtggtattggctactcgcctattacggtatggacgttctggggccaagggccgcacgtcaccgtctcctcagcctccaccacggcccagtccgtccttcccctggccgccctcgcctccgacggacgcaccctccggacgacgcacg

SEQ ID NO: 147113 - DNA, 771 bp, Homo sapiens
  misc_feature: GYAE6OF02IEAX7.21.70.G04.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtanacacgtcaggaaccagttctccctgaagctgaactctctgacccgccgcagacgcgggtatatattatgtgcgagactatagtggtattggctactcgacccttagttacggtaatgggaccgttcgtagggggacccaagggggaccccgtcgaacgggttcccaacccgggtttcctaccccgtttcgaccggtccccttacccccgaaccccgaaaccgggggtcccctaacggttccccgggttccccgttttccccccccggtcggggtcccccggtccccccgtttaccgggtcccttaccccggaacgggtaccggtacccgtaacccccgttccccgggtaacggacccgacccgaaaccggacccggtcccggggcccccggttcggggccttccgggtcccgttccggggtacccgtaacgggaacccgtttaacccggtttaccccggacggttaccccggaaccggtacccgtacgggaccgggcccggggtccggtaccgggacccgaacgggg

SEQ ID NO: 147114 - DNA, 618 bp, Homo sapiens
  misc_feature: GYAE6OF02I47QM.21.70.G04.1.454.CMB.1.raw
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcatttatcacgtggggctggatccgccacgcccccgagggaaggggcgtggaggtgggttgcggtagttatttttcatgagtgggaccacctactataggtcgtcgctcaacagtcgagtcaccatatccgtanacacgtccaggaaccattcctcctgaagcgtgaaccttctctcgaccgccgcacggacggcggtatatatttatgtgacgagacatagtgtatggctacncgtcctaagttacggtangggtacgtcgtcggggaccgaagggcccgcgacgttccaccgttcctcctacacgtccctacccgaaccgaccgggacccacggttccgttaccccgtttcccccggcgggtcccgtccccgttacggtcccttaccgaacgggtacccgccctaaccccgtcccggacggtaccggaccgtaaccgg

SEQ ID NO: 147115 - DNA, 586 bp, Homo sapiens
  misc_feature: GYAE6OF02HKYTO.21.70.G04.1.454.CMB.1.raw
  modified_base (370)..(370): a, c, t, g, unknown or other
  misc_feature (370)..(370): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccgagggaagggctgggagtgggttgcgtagtattttcatgatgggaccacctactataggtcgtcgctcaacagtcgagtcaccatatccgtagacacgtccaggaccagtctcctgaagctagaactcctctcgacccgccgcacgacgcgggtataatnttaattgtgcgagacatagtggtattggctactcgtacctagttacggtatggacgttgcggggtccaacggggaccacgacgtcaaccgttctcctccagtcccctcaacccgtaacggccccagttcccggtccttccccccgtggggcccctcccgtacgtcccgtacccgaggtccgaccctacccgtcccggaacgtacgcctaacccggg

SEQ ID NO: 147116 - DNA, 667 bp, Homo sapiens
  misc_feature: GYAE6OF02JAOC7.21.70.G04.1.454.CMB.1.raw
  modified_base (227)..(227): a, c, t, g, unknown or other
  misc_feature (227)..(227): n is a, c, g, or t
  modified_base (471)..(471): a, c, t, g, unknown or other
  misc_feature (471)..(471): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccagggaagggctggagtgggttgcgagtatttttcatgatgggaccacctactataggtcgtcgctcaacagtcgngtcaccatatccgtagacacgtccaggaaccagttctccctgaagctgaactcaactgaccgcgacacggacgcgggtatacgtattattgtgcgagacagtagtgtattggactacgtcgacccttagttaccggtatcggacgtcgtaggggacctaagggggacccagaacggtccaaccggttctacccgtcgacgtccctacgacccgtaacggccctaagtcccggtaccttccccgnggtcccgtcccgtcgccctccgacggtaccgaccgaaccgtccgacgtaccgaccaacgaccggccggacccgttcgggaccctcgggtcccgtacggtaccgaaaccgggtaccttaaccgttccccgttaccggttacccttaccgtaccgttcggaaccggtccgggtaccgttacggggaccgtaaaccggg

SEQ ID NO: 147117 - DNA, 790 bp, Homo sapiens
  misc_feature: GYAE6OF02JRUPI.21.70.G04.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtgggctggactccgccacgcccccgagggaacggggctcgggaggttgggttcggccgtaggttatttttccgagttaggagtcgggaacctaccgttaccttaagttacggtccgtacgtccgtacgaaaccgtagtacggacgttccaacgtacttacttaccggagtacctaaccgtccgaacggtaaaccctacgttccttacccgtagaacgtctagaactcctacgtacggacccgctacgacgaacggtcgggtaatagttattagttntggcgtaagtacctaagttaggtaggtacgtttcgggacccttaggtacccgtaccgttaacggttaaacgggttctacgggtacgttacgggttaccgggggaacccgtagggaaccctccggaaccggttacccgtacccggttacctacccgtaccgaccgggttaccccctaccggtaaaacccggtacccggaaccccgttacggttaccccggttcccgtttacccccggcgggttaacccccggtccgtacccggttcccacccggggtaacgtccggaccgtaccccggtaacgggaccgtacggaccgtaacccggg

SEQ ID NO: 147118 - DNA, 568 bp, Homo sapiens
  misc_feature: GYAE6OF02FRAOE.21.70.G04.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctacgtcgccctattacggtatggacgtcgtggggccaaggggacccncagtcaccgtctcctcacgcctccaccaaacgggcccaatccggtcctttccccccgtcggccgcccctcgcctccgaggacgccacctccgagacgccacacgccggccctgggccgtcgcctcggtccaacggcttaccttccctcgttcctccgtactcggacggcgggctcgggcaacggg

SEQ ID NO: 147119 - DNA, 746 bp, Homo sapiens
  misc_feature: GYAE6OF02I51J6.21.70.G04.1.454.CMB.1.raw
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagccccagggaagggccgtggaggtgggtcgcgtagtttatttcagtgtaggtacggacctaccgtaactagtacggtcgtcgtctacgaacgtagtacgtagtaccaactattacgtaccgtacgaaccgtaccgtacgaacggtaaccgttacgttcccttaccgtagaacgtctaacgtaacctccttacgtaccggaccccgtccgacgtacggacggtacggttaatattaatttagttagtcgacgactactaagttacgtggttagttcggtaccttacggtccctaccgtttaaggttacgtagttacggtcgttcgggacgggaacccggtaacgggacctacgtacggttacccgacccgttccgttccgtaccgaccgttaccccgtaacccaaaccggggtaacccgggcccctttaccggtttcccggttaccccctttcccccgggtgggacccccgttcccgtccgttaccccggacggaccgggtacctcccgtaaccccgtaccgggaaccgtaaccgg

SEQ ID NO: 147120 - DNA, 605 bp, Homo sapiens
  misc_feature: GYAE6OF02ILZLG.21.70.G04.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccagcccccagggaaggggctggagtgggttgcgagtattttcatgatggaccactactataggtcgtcgctcaacagtcgagtcaccatatccgtagacacgtccaggaaccagttctccctgaagctgaactctctgaccgccgcagacgcgggtatatattatgtgcgagacatagtgtattggctacncgcctatacggtatggacgtcnggggccaagggccacagtccaccgtctcctcgacgcctcccaccgaacggcccatccggtccttacccccgtggcccgccctcgcctaccgacgggtacgccctacccgtaccgacggacgaccgaactacggcccgggtacccgtcgggccgtcgccgttcggtaccgaagggtcccttaaccggttccccttaccggtaccttaccgtaccgtacggaccggtcgggtccgtcgggtacaaccggg

SEQ ID NO: 147121 - DNA, 660 bp, Homo sapiens
  misc_feature: GYAE6OF02F7KV9.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtgtatggctactcgcctattacggtatggacgtcgtggggcctaaggggacccgcagtccacccgtctccctcacgtccctccaacccgaacgggcccctagtcccgggttcccttccccccgtcgggcccgtcccccgtcgtcccttacccgacgggacgaccgtacccctcccgggagtaccgcccaaccgtacggcccgggtccccgtcggggacccgttcggccccgttacgggtaccgaaacggggtacccttacccgttaccccggacggacccggtaaccgaccgttacgggacgggccgggggtccgtacgggaccgaaccgggg

SEQ ID NO: 147122 - DNA, 535 bp, Homo sapiens
  misc_feature: GYAE6OF02JAO1W.21.70.G04.1.454.CMB.1.raw
  modified_base (349)..(349): a, c, t, g, unknown or other
  misc_feature (349)..(349): n is a, c, g, or t
  modified_base (520)..(520): a, c, t, g, unknown or other
  misc_feature (520)..(520): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagacacgtccaggaaccagttctccctgaagctgaactctctgaccgccncagacgcggtatatattattgtgcgagacatagtgtattgctactcgcctattacggtatggacgtcgtgggaccgaagggccgcagtccaccgtctcctcacgcctccaccgacggcccagtccgtccttccccgtaggcccgtccctcgcctaccgaggacgccacccnccggagacgcaccgg

SEQ ID NO: 147123 - DNA, 552 bp, Homo sapiens
  misc_feature: GYAE6OF02FWHC8.21.70.G04.1.454.CMB.1.raw
  modified_base (265)..(265): a, c, t, g, unknown or other
  misc_feature (265)..(265): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccactactataggtcgtcgctcaacagtcgagtcaccatatccgtagacacgtccaggaaccagttcnccctgaagctgaactctctgaccgccgcagacgcgggtatatattattgtgcgagacatagtgtattggctactcgccctattacggtatggacgtcgtggggccaaaggggcccgcagtcaccgtctcctcacgcctccaccacggcccatccgtcctcccctcggccgccctcgcctccgagacgccacctccgagacgacaccagccgcccgtgggcctcgccgtggtcgaacggcctaccttcccggacgccgaccgactcggacgcgggcgtacggcaacgg

SEQ ID NO: 147124 - DNA, 637 bp, Homo sapiens
  misc_feature: GYAE6OF02H7DEI.21.70.G04.1.454.CMB.1.raw
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagtcgtcgctcgcacgaccggtgctcgatttagtgtagtgtgaagggaaagggtctccgaaggcttcaccagtcctgggtcctgtccagctgcagctgcaggagtcgggcccaggactggtgaagccttcggagaccctgtccctcacctgcactgtctctggtggctccatcatcaatggtcattatcactggggctggactccgccacgccccgagggaacggggctggagtgggtgcgtagttattttcatgatgggaccactactataggtcgtcgctcaacngtcgagtcaccaatatccgtagacacgtaccaggaaacctagttcnccctgaagctgaactcnctcgaccgcgcagacgcgggtatatattattgtgcgagacagtagtggtatggctactcgaccctattacggtacgtggtaccgtcgtacggggaccgtaaggggacccggtcgaacggtaccacccgttaccgttcccttaccgaccgtcccttacccgaaccccgtaaacgggcccccgaacgttcccgggtttcccttccccccgtacgggtccccgcccccgtttcgacccgttcccggaacgggaccggtacccgtacccgttaccccggagtaacccgg

SEQ ID NO: 147125 - DNA, 543 bp, Homo sapiens
  misc_feature: GYAE6OF02JW587.21.70.G04.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatggaccacctactataggtcgtcgctcaacagtcgagtcaccatatccgtagacacgtccaggaaccagttcctacccgtagaagctgaactcnctcgaccgcncagacgcgggtatagtattattgtgacgagacatagtggtatggctactcgcctattacgtatggtacgtcgtgggaccaagggaccncgacgtcacgtcctctcncgtcctaccaccgaacggcccagtccggtacttccccgtggcccgccctgcctccgaggaccgccgtacctccggacacgcaccgg

SEQ ID NO: 147126 - DNA, 808 bp, Homo sapiens
  misc_feature: GYAE6OF02JZHBT.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccacgcccccgagggaagggcgtggagtgggttgcgagtattttcatgatgggaccactactatacggtcgtcgctcaacaggtcgagtcacatactcgtagaccacgtccacggaaaccaggtttcctcctagaacgtctagaactctcacgtaccgcgcgaacgacgtcgggtaattacgtaaattcgtttacgcggtaccgtaaggtaaccgtaagttaggttagggttaagtttgggtaccgttaaccgttccgtacccctttaacgtttaaccggggttaagttacgggtaacccgtttacgggttacgggggtaacccgtaaaacggggggtacccgtaccggaacgttacccggtaaccccggttcccggtttacccccgtaacgtaacccgggtacccccgtttaaccccaaaccccgggtaaaccggggacccccttaacgggttttaacccccgggtccccgttttaaccccccgggtttaccggggccccctcccccgggtttaccggacccccgtttacccgggtaaccgggacccggttacccgaacccccggtttaccccggaacgggttaacccggaccccgttaaacccggg

SEQ ID NO: 147127 - DNA, 627 bp, Homo sapiens
  misc_feature: GYAE6OF02JSWAJ.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaacgggctggacgtgggttgacgtagttactttttcagtgagtcgggaccactactagtaggtcgtcgctacacagtcgagtcaccgtatacgtccgtagacacgtccaaggaaccagttcctcccgtagaacgctagaacctctctcgacccgccgtcaggaccggtcgggtaatactattagttgtcgacgtagacagttaggtcggtattacggctacgtccgtaccttaagttacgggtatcggtacgttcgtcgggggaccaacggggacctcgacgttaccgaccgttctacccgttcgacgtccctaccgaccgaaccgggcctacgtccgttaccttcccgcggacccgtcctcgcccttacgacggcctacccgtccgtaccggacgtaccgactacccggg

SEQ ID NO: 147128 - DNA, 628 bp, Homo sapiens
  misc_feature: GYAE6OF02HTNXA.21.70.G04.1.454.CMB.1.raw
  modified_base (595)..(595): a, c, t, g, unknown or other
  misc_feature (595)..(595): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtggggctggatccgccagcccccagggaagggctggagtgggttgcgtagttatttttcatgatgggaccactactataggtcgtcgctcaacagtcgagtcaccatatccgtagacacgtccaggaaccagttcctccctgaacgctagaactctctgaccgccgacacgacgcggtaatattattatgtgcgagacagtagtggttatggactactcgccttagttacggtatggacgtcgtcgggaccgaaggccgacagtccaccgtctcctcacgcctacccgaaccgaacgggcccagtccggttcccttccccgtcggcccgtccctcgccgtccgaggaccgccgtaacccgtccgacgacgaccgaccgacggcccggcccggtggccgtcgacccgttgggtacccgaacggtaacccgttcccgttacccgttccgttaccgttccttaccgnggaccggtcggggtccttacgggacctaacggg

SEQ ID NO: 147129 - DNA, 543 bp, Homo sapiens
  misc_feature: GYAE6OF02GKN6W.21.70.G04.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaacggggctggagtgggttgcgagtattttcatgatgggaccactactataggtcgtcgctcaacagtcgagtcaccatatccgtagacacgtccaggaaccagttctcctgaagctgaactctctgaccgccgcacgacgcggtatatattaatgtgcgagacatagtggtatggctactcgccctattacggtatggacgttcgtgggccagggcncgagtccaccgtctcctcacgtcctccaccaacggcccatccggtccttccccgtcgggccgtcccctgccgtcccgaggacgaccacccgtcccgagaccgcaaccgg

SEQ ID NO: 147130 - DNA, 602 bp, Homo sapiens
  misc_feature: GYAE6OF02HJXLJ.21.70.G04.1.454.CMB.1.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (383)..(383): a, c, t, g, unknown or other
  misc_feature (383)..(383): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtggggctggatccgccagcccccagggaagggctggagtgggttgcgagttatttttcatgatgggaccacctactataggtcgtcgctcaacagtcgagtcaccatatccgtagacacgtccaggaaccngttcnccctgaagctgaactctctgaccgccgcagacgcgggtatatattacttggtncgagacatagtggtatggctactcgccctagtacgtatggacgtctggggccaaggggacccncagtccaccgtctcctcacgtcctaccaccaacgggcccacgttccggtccttcccccgtggccgtccccgtgcctcccgaggccgccacccgtccgacgacgccaccgacggccgccccgtggcctcgcccgtcggtcgaacggtacccttacccgttccctaccgttcccttaccgttacccgtcggacggtccgggccgtcgggaccgtaaccggg

SEQ ID NO: 147131 - DNA, 559 bp, Homo sapiens
  misc_feature: GYAE6OF02G0W0W.21.70.G04.1.454.CMB.1.raw
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
  modified_base (469)..(469): a, c, t, g, unknown or other
  misc_feature (469)..(469): n is a, c, g, or t
  modified_base (506)..(506): a, c, t, g, unknown or other
  misc_feature (506)..(506): n is a, c, g, or t
  modified_base (531)..(531): a, c, t, g, unknown or other
  misc_feature (531)..(531): n is a, c, g, or t
tcagtcgtcgctcgcacgaccggtgctcgatttagtgtagtgtgaagggaaagggtctccgaaggcgttcaccagtcctgtcccagcctgcagctgcacggagtcggcccaggactggtgaagccttcggagaccctgtccctcaccctgcactgtctctggtggctccatcatcaatcggtacattatcacgtaggggctggactccgccacgcccccgagggaaggggctgggacgtgggttgcgtagttattttcatgatcggaccacctactatacggtcgtcgctcaacagtcagtcacatatccgtancacgtccagaaccngtcnccnganctgaactctctcgaccgccgcaggacggtcggtatatattattgtgacganacatagtggtattggactacgtccgcctagttacggtatcggacgttgtcgggaccaagggccnacgtcaccgtctcacncgtccaccaccgacggcccagtccggtacctccccgnggcccgtccctgcctccgaacggcnccgtacccgtcggacgtacgactaccgg

SEQ ID NO: 147132 - DNA, 622 bp, Homo sapiens
  misc_feature: GYAE6OF02GG27O.21.70.G04.1.454.CMB.1.raw
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
  modified_base (479)..(479): a, c, t, g, unknown or other
  misc_feature (479)..(479): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaaggaaccagttcctccctgaacgctgaacttctctgaccgccgcagaccgcgggtatatattattgtgcgagacatagtggtattggctactcgcccttagttacggatggacgtcgnggggccaaggggcccncgagtccacccgtctcctcacgtccctccgaaccgaacgggccccacgttccggtccttcccccgtcggcccgtccctcgcctccgaggcnccgaccgtccgacgacgccgacgaccggccggacccgtcgggccgtcgtccgtacgggtaccgaaacgggtccttacccgttccccgttccgttaccttccgtacgtcggtaccgggcgggtccggtcgggaccgtaaccggg

SEQ ID NO: 147133 - DNA, 606 bp, Homo sapiens
  misc_feature: GYAE6OF02IW4S8.21.70.G04.1.454.CMB.1.raw
  modified_base (295)..(295): a, c, t, g, unknown or other
  misc_feature (295)..(295): n is a, c, g, or t
  modified_base (510)..(510): a, c, t, g, unknown or other
  misc_feature (510)..(510): n is a, c, g, or t
tcagtcgtcgctcgcacgaccggtgctcgatttagtgtagtgtgaagggaaagggtctccgaagccttcggagacccctgtccctcacctgcactgtctctggtggctccatcatcaatggtcattatcactggggctggatccgccagcccccagggaaggggctggagtgggttgcgagtattttcatgatgggaccacctactataggtcgtcgctcaacagtcgagtcaccatatccgtagaccacgtccaggaaccagttcctccctgaagctgaactctctgccgccgnagacgcgggtatatattattgtgcgagacatgtggtatggctatccgccttatacggtatggacgttgtcggggccaagggccgcaggtccacccgtctcctccacgccctaccaccgaacgggcccacgtccggttccttccccccgtggccgtccctcgcctccagggacaccgaccctccgacgacgccacgacggcccgccgtcgggtccncgtcccgtgggtccgaacgggtaccttacccgttcccgttaccggttcccttaccttaccgtcggaccgggtccgggtaccgtcgggacgaacggg

SEQ ID NO: 147134 - DNA, 619 bp, Homo sapiens
  misc_feature: GYAE6OF02F61DW.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagttatttttcatgatgggaccacctactataggtcgtcgctcaacagtcgagtccaccatactccgtagacacgtccaaggaaccagttcctccctgaagctgaactctctgaccgccgcagacgcgggtatatattatgtgcgagacatagtggtattcggcttactccgcccttagttacggtatcggacgtcgtcggggaccaaaggggccgcgacgtccacccgttctcctcacgccctacccaaccgaacgggcccacgtccggttcccttcccccgcggtcccgccctcgtccctccgacggacgcctacccgtccgacgacgacacgacggcccggcccgtcgggcctcggcccgttggtaccgaacggtacccttacctttccccgtcgttcccttcgttacgtcggacggccgggacgtcggacgaacggg

SEQ ID NO: 147135 - DNA, 764 bp, Homo sapiens
  misc_feature: GYAE6OF02J3IT0.21.70.G04.1.454.CMB.1.raw
  modified_base (744)..(744): a, c, t, g, unknown or other
  misc_feature (744)..(744): n is a, c, g, or t
tcagtcgtcgctcgcacgaccggtgctcgatttagtgtagtgtgaagggaagggtctccgaaggcttcaccagtcctgggtcctgtcccagctgcagctgcgaggcgtccggccaggactggtacgacgtccgttaccggacgtacccttcgtcccctcgacctgtcctacgtcgtccgttcgtggtcgtcctacatcctattacgaagttcgtactacgttaccgtcggtaccggttcggcgtaccggtacccgccgaccggaccggtaccgggagggtcggtacgtggtacgggtcgtacgttacgtttagttacttacgacgtacgttaccgaccgtacctacgtacgtacggtcgtacgtactaccgtaacgtacggttacgactactacctacgttccacgtaaccgcgaccgtacgtacgtaacctcttacgtcgaactcgtaactcgacctccgtccgacggacccggtcaacggtagttaaccggtacggtttattaacgttacgttgtaacggtacggcgtaacgtagtagttacgtcggtttacttaccgaccgttacgtaccgtacgttaggtacggtcggtacggtacggtacccgggtaggaaccgtcggactaccgtcgttcctaacccggtcctaccacccggtcccgtaccgtaaccacccggcgttacccgcttccccgaccgttccggtcgacctccggtcgaaccttccggacgtccggaccgtnaacccggtcaccggtaccgg

SEQ ID NO: 147136 - DNA, 550 bp, Homo sapiens
  misc_feature: GYAE6OF02HRX0D.21.70.G04.1.454.CMB.1.raw
  modified_base (414)..(414): a, c, t, g, unknown or other
  misc_feature (414)..(414): n is a, c, g, or t
  modified_base (470)..(470): a, c, t, g, unknown or other
  misc_feature (470)..(470): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagcccccgagggaggggctggaggtgggttgcgtagttattttcatgagtgggaccacctatataggtcgtcgctcaacagtcgagtcaccatatccgtagacacgtccacggaaccacgttctccctgaacgctcgaaactctctcgaccgccgcacgacgcggggtatatattattgtgcgagacatagtgtatggctctcncctattacggtatggacgtcgtgggccgaagggaccgcgagtcaccggtctcctcncgccctccaaccgaacggcccagtccggtccttccccgtcggccgcccgtcgcctcgacggcgccaccgttccgagaccg

SEQ ID NO: 147137 - DNA, 605 bp, Homo sapiens
  misc_feature: GYAE6OF02IVLG9.21.70.G04.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggagggctggagtgggttgcgagtattttcatgatgggaccacctactataggtcgtcgctcaacagtcgagtcaccatatccgtagacacgtccaggaaccagttctccctgaacgctgaactctctgaccgccgcagacgcgggtatatattatgtgcgagacatagtggtattggctactcgcccttattacggtatggacgtcgtggggaccaaaggggccncgacgtccaccgtctcctcacgtccctccaccgaacgggcccacgtccggtcccttccccgtggcccgtcccgtgcctccgacggcgccgacctccgagcgaccacgacggccggcccgtcgggcctacggtcccgttgggtaccgaacgggtacccttaccgtttccccgtccgttcctaccgttacgtacggacggtccgggtcgttacgggacctaacggg

SEQ ID NO: 147138 - DNA, 595 bp, Homo sapiens
  misc_feature: GYAE6OF02IQCBI.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaggggctggagtgggttgcgagttatttttcatgatgggaccacctactataggtcgtcgctcaacagtcgagtcaccatatccgtagacacgtccaggaaccagttctccctgaagctgaactctctgaccgccgcaggacgcgggtatatattattgtgcgagacatagtgtattggctactcgcctattacggtatggacgttcgtggggaccaaggggaccgcgagtccaccgtctcctcacgcctccaccgaacggcccagtccggtccttcccccgtggccgccctgcctccgagggacgaccaccctccggagacgacaaccgacggccggccccgtgggccgtcgccgtggtaccgaacggtacccttacccgttccccgtcgttccttaccgttaccttcggacggccgggtcgtcgggactaaccggg

SEQ ID NO: 147139 - DNA, 578 bp, Homo sapiens
  misc_feature: GYAE6OF02FMXJV.21.70.G04.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaacggggctgggaggtgggttgcgtagttattttcatgagtcgggaccacctactataggtcgtcgctcaacagtcgagtcaccatatccgtanacacgtccaggaaccngttcctcctgaacgctagaactctcngaccgccnacgacgcgggtataattattattgtaggcgagacagtagtggtattggcttacgtccgtaccttagttacggtagtgggtacgttcgtcggggaccgtaacggggccgacgacgtccgaccgtctacccgtcacgtccctccgaccgaacggccctacgtcccgtccttccccgtaggcccncccgtgcctccgacgcnccacccgtcgagcgcaccg

SEQ ID NO: 147140 - DNA, 582 bp, Homo sapiens
  misc_feature: GYAE6OF02GI1QF.21.70.G04.1.454.CMB.1.raw
  modified_base (327)..(327): a, c, t, g, unknown or other
  misc_feature (327)..(327): n is a, c, g, or t
  modified_base (568)..(568): a, c, t, g, unknown or other
  misc_feature (568)..(568): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagcccccgagggaacgggctggagtgggttgcgagttatttttcatgatgggaccacctactataggtcgtcgctcaacagtcgagtcaccatactccgtagacacgtccaaggaaccagttccnccgtagaacgctagaactctctcgacccgccgacacggacgcggtatactattagttgtggcgagacagtagtaggttattggacttacgtcgtccctagttaaccggtatcggtacgttcgtacggggaccgaaacgggaccgtcgacgtcgtaccgtcctccctcacgccctaccaccgaacggcccacgtccgtccttccccgcggcccgtccctcgccttccgaggacgccgacccnccgacgacgcaccg

SEQ ID NO: 147141 - DNA, 673 bp, Homo sapiens
  misc_feature: GYAE6OF02IWH90.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggatccgccacgccccgagggagggctggagtgggttgcgagttattttcatgtagtcggaccacctactagtaggtcgtcgactacaacagtcgagtcacctatacgtccgtagacctacgtaccgacggaacctacgtttcctacccgtagaacgtcctaggtaacctcctccgtcgaccgccgcgaaggaccgtacgggtaattattatttagttaggtacgcgtagtacgtagttaggttaggttagttcggtacttaccgttccgtaccttaagttacggttagtcggtacgttcggtacgggaccgaagggacccgacgtacgtaccgaccgttctacccgtcgaccgtacccgtaccgaacccgaacggtccctaacgttcccggttacccttaccccggttcggcccgtccccgtaggtccctccggaacggacgtcccgtacccgtaccggaacgaccgtccaacccgg

SEQ ID NO: 147142 - DNA, 590 bp, Homo sapiens
  misc_feature: GYAE6OF02HFWAI.21.70.G04.1.454.CMB.1.raw
  modified_base (324)..(324): a, c, t, g, unknown or other
  misc_feature (324)..(324): n is a, c, g, or t
  modified_base (443)..(443): a, c, t, g, unknown or other
  misc_feature (443)..(443): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgtagtattttcatgatggaccactactataggtcgtcgctcaacagtcgagtcaccatatccgtagacacgttccaggaaccagttctccngaagctgaactctctgaccgccgcagacgcggtatatattattgtgcgagacatagtgtattggctactcgcccttagttacggtatcgggtacgtcgttggggaccaaggggacccgngacggtcaacccggttctccctcacgtcccttccgaaccgaacggccctaacgttcccggtccctttacccccgcgggtcccgtccccgttgtccccgtacgaacgggtacctcccgtacccgtcccggaacgtcgacctaacccgg

SEQ ID NO: 147143 - DNA, 687 bp, Homo sapiens
  misc_feature: GYAE6OF02J0MS7.21.70.G04.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggatatattatgtgcgngacatagtggtatggctactccgccctattacggtatggtacgtcgtggggcaacggggaccgcaggtccaaccggtctccgtcacgtccctccgtaacccgaacgggcccctaagttcccgggttaccctttccccccgtcgggtcccgtccccgttcggcccttcccggaacggtacgacccgacccgttacccggaacgaccggtacccgaaccggtaacgggcccggccccgttacgggccttaccgggtccgttccgggtaaccgaaccgggtaacccttacccgttttccccgtaccggttaccctttacccggttaaccgtacggtacccggaccgggggtcttccggggacgtaacccgggg

SEQ ID NO: 147144 - DNA, 587 bp, Homo sapiens
  misc_feature: GYAE6OF02HMXG9.21.70.G04.1.454.CMB.1.raw
  modified_base (283)..(283): a, c, t, g, unknown or other
  misc_feature (283)..(283): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaagggctggaggtgggttgcgagttattttcatgatgggaccacctactataggtcgtcgctcaacngtcgagtcaccatatccgtagacaccgtccaggaacccagttcctcctgaagctgaactcctntcgacccgccgcacgaccgctggtaactattaatttattgtgacgaganagtagtggtattggctacgtcgtcctattacggtatggacgttcgngggtaccaagggaccgacagtccgaccgtctccctcgcnccctacccaccgaacgggtcccacggtccgtcccgtttcccccgtcgggccctacccgtccgcccgtacccgcgggaccgccgtacccctaccggacgtacgacccg

SEQ ID NO: 147145 - DNA, 562 bp, Homo sapiens
  misc_feature: GYAE6OF02GIS3Y.21.70.G04.1.454.CMB.1.raw
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (459)..(459): a, c, t, g, unknown or other
  misc_feature (459)..(459): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagcccccagggaggggctggagtgggttgcgagtattttcatgatgggaccacctactataggtcgtcgctcaacagtcgagtcaccatanccgtanacacgtccaggaaccagttcctcctgaagctgaactctctgaccgccgcagacgcggtatatatttatgtgcgagactatagtgttatgctctcgtccctatacggtatggacgtcgtgggccgaaggaccgcgaagtccacgtcctcctcncgccctccaccgacggccctacgttccggtcccttcccccggtaggcccgtaccccgtccgccgttacccgacggaccggcccacccggtcccgacggaaccg

SEQ ID NO: 147146 - DNA, 806 bp, Homo sapiens
  misc_feature: GYAE6OF02H92YL.21.70.G04.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccacgcccccagggaacgggctggagtggttgcgagtattttcatgatgggaccactactataggtcgtcgctacgaacngtcgagtcaacctatactccgtagtaccacgtccgaggaacctagttcctcctagaacgctacgaactcttcgtacgacccgcgaccgaggaccgacgggttaataacgttatttaagttcggttacgaccggtaagtaacccgtaagttaacggtttaggttaacggttttacgggtaccgttaaccgttaccggtacccccgtttaaaggtttaaccgggtttaacggttacggggtaacccggttacgggtttaccggggggtaaacccggaaacccgggggtaacccggtaccggtaaccgggtacccgtaaacccgggttccttaccccgtacccggtaccgtaccccgtttaccgaaccccggtaaaccgggtaccccgtaacgttaccccgggttacccccgtttaccccccggtaccggggtcccccggtcccgttccggtaaccccggtttacccggacgggtaacctaccccggtaccccgttaacccggaaccggttaccggaccaaaccccggg

SEQ ID NO: 147147 - DNA, 632 bp, Homo sapiens
  misc_feature: GYAE6OF02GJ88S.21.70.G04.1.454.CMB.1.raw
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgagtatttttcgatgatgggaccacctactataggtcgtcgctcaacagtcaagtcaccatatccgtagacacgtccaggaaccagttcnccctgaagctgaactctntgaccnccgnagcgcggtatatattattgtgcgagacatagtggtattggctactcgccttattacggtatggactcgtgggccaagggaccgcagtcacccgtctccctcacgcctccaccgaacgggccctaacgttccgttaccgtttccccccgtacggtcccgccccgttcgccgttcccgaggtaccgccacccgttcccggagtacggccaaccgacggccggtcccgtggtccgttcgcccgttgggttaccgtaacggtccttaacccgtttccccgtaaccgttccgtttaccgttaccgttcggtaccggccgggtccgtcggggtaccgaaccggg

SEQ ID NO: 147148 - DNA, 586 bp, Homo sapiens
  misc_feature: GYAE6OF02HZVDD.21.70.G04.1.454.CMB.1.raw
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
  modified_base (486)..(486): a, c, t, g, unknown or other
  misc_feature (486)..(486): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatgtcattatcactggggctggactccgccacgccccgagggaggggctggaggtgggttgcgtagttatttttcatgagtgggaccacgtactataggtcgtcgctcaacagtcgagtcaccatatccgtagacacgtccaggaaccagttccnccctgaacgtctgaactctcctgacccgccnacggacgaccgggtatactattacttgtgcgagtanatagtggttagtggtctactcgcctagttacgtagtggtacgttcgtcggggaccaacgggaccgcgtacgtccaccgtcctcncgacgtcccaccaaccgtacggccctacgtccggttccgttacccccgtcggccgcccgtcgccgtaccgacggaccgaccgacccgtaccggagtacgg

SEQ ID NO: 147149 - DNA, 718 bp, Homo sapiens
  misc_feature: GYAE6OF02IP4R5.21.70.G04.1.454.CMB.1.raw
  modified_base (582)..(582): a, c, t, g, unknown or other
  misc_feature (582)..(582): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtgggctggactccgccacgcccgagggagggctggagtgggtgcgtagttattttcatgagtcggaccacctatagtacggtcgtcgctacaactcgtcgacgtcaacaatacgtaccgtacgaccgtaaccgtaccgaacggtaacctacgttccctaccgtagaacgtcgtacgtaacctctaccgtacgacccgaccgacgtaacggaccggtacgggttaattaacttaagtttacgttacgttggacgtaaggtaactagtttaggttaggttagttcgggtacttaccgttccgtaacccttagttaaccgggtagttcggtaaccggttcggtaacggggaccgtaacgggaaccgcgtacgtaccgtacccgttcctaccgttaccnccgtaccctaaccgaaccgtaccggacccgtaccgttcccgtaccccgttccccgtccgggccccgttcccttaccggtccgtacccggaagccccggtacctacccgtaaccgggccgaacgtacccgaacccgg

SEQ ID NO: 147150 - DNA, 690 bp, Homo sapiens
  misc_feature: GYAE6OF02H7CGN.21.70.G04.1.454.CMB.1.raw
  modified_base (155)..(155): a, c, t, g, unknown or other
  misc_feature (155)..(155): n is a, c, g, or t
  modified_base (459)..(459): a, c, t, g, unknown or other
  misc_feature (459)..(459): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtcctcacctgcactgtctntggtggctccatcatcaatggtctatatcagtgggctgatccgcacgcccagggaagggctggagtgggttgacggtattatttttcatagacgtgggaaccacctaagtagtacggtcgtcggactacgaaacctaggtaccgagtaccaacctaatattccggaataccacgtaccaaacggtaacccaggtttcctcccgtaggaacgtccttagaaactcttccacggaaccgcgacgagtaccggaggtactaatacgtttagtgtcgacgtacgatagtagtgtacgttcggactacncgtacctagttaacggagtcgaacgttcgacggggacaaaacggggcccgaacgacggttaccgtaacccgtttactcccgtacgtaccgacccgttaccccgaaacggaaacccgggtacctaacggttacccgtacccgttttacccccgtccgggactttacccccggcgaaccttcccggaacggttacggaccgttaaccgaccccggtaaggacgtaccgaacgg

SEQ ID NO: 147151 - DNA, 641 bp, Homo sapiens
  misc_feature: GYAE6OF02FXWW5.21.70.G04.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggacggggctggagtgggttgcgagttattttcatgatcggaccactactataggtctcgctcaacagtcgagtcacatatccgtanacacgtccaggaaccagttcctcccgtagaacgctacgtaactctctcgaccgtccgacacggacggtcgggtaattagtatttatgtgtacgagtactataggtggttagttggtactaccgttctacccttaggttaaccggtagtcgggtacggttcggtcggggaccgaacggggacccgacgacgtcctaacccgtccttcccgtcgacgtccccgtaccgaacccggaacggccctaaccggttccggttccccttcccccgtcgggccccgtaccctcggtccctaccgaacggccgtcccaacccgtccggaacggtaccgacgtaacccgg

SEQ ID NO: 147152 - DNA, 655 bp, Homo sapiens
  misc_feature: GYAE6OF02IYKFT.21.70.G04.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtctattactcacgtggggctggactccgccacgccccgagggaagggcgtggacggtgggttgacgtagttactttttcagtgagtcggaccaacctatagtaggtcgtcgctcaacgagtcgaagtccaaccatacgtcgtanaccacgtccaagaacctgtacctctagacgctcgaactctcacgacccgcacgagaccggtggtaatattatttagtgtcgagtacgtaatacgtaggtcggttagttcggtactacgtccctaccgttacgttaacggtgtacggtacgttcggtcgggtaaccgacgggaccgtacgaccggttcgaacccgtcttacccgtccgacgtcccttaaccgacccggaacggtccctaagttcccgggtttaccctccccggtacggccccgtaccgtccggcccttaccgggaatccgggacccttacccgcgtaaccggacacccgtaaccgg

SEQ ID NO: 147153 - DNA, 875 bp, Homo sapiens
  misc_feature: GYAE6OF02IBOZ6.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctgggactccgccgacgcccccgaggggacggggcgtgggaggttgggttggacgtagttactttttcagtgagttcgggaacctaccttacgtagtaggtccggtcgcctacaacgtagtcgacgtccaccagtactaccggtagaccgtacgtaccgaaggtacctagttccaccgtagaacgtctacgaccttctccgtacgaccccgtcgaccgtacggaccggtacgggttaactaacgtttacgttttacgtttaggtcggtacggaaacgtaaccgttaagtttaacgggtttagggtttaaacggtttcgggttaccctttaaccccggttccggttaaccccgtttaacggtttaaaccgggttaaggtttaccgggtaaaccgggttccggttaccgggggggtaaacccgtaaaccgggggacccggtaccggtaaccggttccgtaaccccggtttcccgttacccgtaccgtacccgtaccccgttaccccgaaacccggtaacccggggaaccccttaccgggttaccccgggtttccccccgttaaccccccggttccggggtacccccgttccccggttcccggtaccccgttacccggtaaccggggaacccgtaccccggtaccccggttacccggaacgggtaccccggaccgtaaccccggg

SEQ ID NO: 147154 - DNA, 721 bp, Homo sapiens
  misc_feature: GYAE6OF02FX5Q2.21.70.G04.1.454.CMB.1.raw
  modified_base (230)..(230): a, c, t, g, unknown or other
  misc_feature (230)..(230): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (399)..(399): a, c, t, g, unknown or other
  misc_feature (399)..(399): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtgggctggatccgccacgccccgagggaagggctggaggtgggtgcgtagttatttttcatgagtacgggaccacctactagtaggtcgtcgctcaacngtcgagtcaccatactccgtagacacgtccaaggacctagttcctcctagaagctagaacttctctcgaccgccgcagacgcggtatatattntgngcgagacagtagtgtattggctacgtcgtaccttagttacggtatcggacgtcggtcgggaccaacgggccgnacgtcccgacccgttctcctcgaccgtccctacccgaacccgaaccggggcccctacggtttccccggttacccctttcccccggtcgggtaccccggtccccgttcgggtacccttacccggaagggtacccgtacccgtaccccggttaccggacggtaccggacccgaaccggtaccggcccgggtaccccgtggggtcccttacgggccgttacgggtaaccgaacgggttaccctttacccggtttcccccgttcgttacccttaccgttaccgtcgggtaaccgggtccgggtccgttacgggaccgtaaccgggg

SEQ ID NO: 147155 - DNA, 673 bp, Homo sapiens
  misc_feature: GYAE6OF02JXFHP.21.70.G04.1.454.CMB.1.raw
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcacgtggggctggactccgccacgccccgagggaacgggctgggagtgggtgcgtagttattttcatgagtgggaccacctactagtaggtcgtcgctcaacngtcgagtcaccatactaccgtagacacgtccaaggtaccagttccnccctagaacgctagtaacctctacgtacgacccgccgcaacggacggtacgggttaactagttaatttagttcggtagacgtaagaactagttaacggttggttaagttgggaccttaccgtccgtacccttaagtttacgggtacttacgggtacgttcgggtacggggccgaaacgggtaccgactaacgttccgaacccggttcttacccgtcgtacgccctaaccgaacccggtacggtaccctcggttaccggttcccccgtacccggtcggccctaccccggtctcccgtaccgacggaccgtcccgtaccccgtacggacgacccg

SEQ ID NO: 147156 - DNA, 611 bp, Homo sapiens
  misc_feature: GYAE6OF02IQWE4.21.70.G04.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagtgtagtgtgaagggaaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactcccgccacgccccgagggaagggctgggaggtgggttgcggtagttattttcatggagtgggacccacctactataggtcgtcgctacaacagtcgagtcacctatagtccgtagacaccgtccaaggaacctagttcctccctgaacgtctagactctctcgacccgccgcaacggaccggtacgggttaattagttaatttagttggtgagagaactgttaggttgggttaattcggactacgtccgtcccgttaagtttacggtagttcggacgttcggtcggggacccgaacgggccgcgacgtccaccgtactcctcgacgtccctaccaaccggacggcccagttccggtcccttccccgtcggccctcccgtcgcctccgaggcnccaccgtcgacacgcacg

SEQ ID NO: 147157 - DNA, 576 bp, Homo sapiens
  misc_feature: GYAE6OF02JHG7A.21.70.G04.1.454.CMB.1.raw
  modified_base (553)..(553): a, c, t, g, unknown or other
  misc_feature (553)..(553): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccacgcccccgagggaaggggctggagtgggttgcgagtatttttcatgatgggaccacctactataggtcgtcgctcaacagtcgagtcaccatactaccgtagaccacgtaccaaggaaccagttcctccctagacgctgactctctcgcccgccgcaggacggcggtatacgttattattgcgcgagacagtagtggtattggcttacgtccgacttacgttacggttagtggtacgtcggtacggggccgaacgggaccgcgagtccaccgtctcctcgacgccctaccgaccgaacggcccagtcccggtccttccccgcggcctcccgtcgccctccgacggtacncccaccgtccgacgacgccgacg

SEQ ID NO: 147158 - DNA, 554 bp, Homo sapiens
  misc_feature: GYAE6OF02FJSDC.21.70.G04.1.454.CMB.1.raw
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
  modified_base (428)..(428): a, c, t, g, unknown or other
  misc_feature (428)..(428): n is a, c, g, or t
  modified_base (502)..(502): a, c, t, g, unknown or other
  misc_feature (502)..(502): n is a, c, g, or t
  modified_base (529)..(529): a, c, t, g, unknown or other
  misc_feature (529)..(529): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggagggctggagtgggttgcgagttatttttcattgatgggaccacctactataggtcgtcgctcaacagtcgagtcaccatatccgtagacacgtccaggaaccagttctccctgaagctgaactntctgaccgccgcagacgcgggtatagtattaattgtgacganacatagtggtattggctactcgtccctagttacgtatggacgttcgnggggccaagggccgcgtacgtcaccgtctccctcacgccctaccaccgaaacgggcccagtccgtccttccccnggcccgccctcgccttaccgacggacnctaacccgtccgacgacgctaccgg

SEQ ID NO: 147159 - DNA, 581 bp, Homo sapiens
  misc_feature: GYAE6OF02FYM5R.21.70.G04.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaacgggctggagtgggttgcgagtatttttcatgatcgggaccactactataggtcgtcgctcaacagtcgagtcacatatccgtagacacgtccaggacctagttcctcctgaacgtctagaactctctgaccgcgcagacggcggtatactatttatgtcgacgagacagtagtggtattggctactcgtcctattacggtatggacgttcgtgggacaagggaccgcgacggtccaaccggtctccgtacgacgtcccgtaccaacgaaccggtccaacgttccggtcccttaccccgngggtccccacccgttcggcctacccgaggacgacctacccgtaccggacggtaccgcctaaccgg

SEQ ID NO: 147160 - DNA, 868 bp, Homo sapiens
  misc_feature: GYAE6OF02G4NSR.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatacaatggtcattatcacgtggggctggactcccgccacgcccccgagggagggctggaggtgggttcgcgtagttatttttcagtgagtcggacctacctactagtaggtcgtcgctacacagtacgagtaccacatactccgtagacacgtaccgaacggaacctagttcctcctagacgtctagaacttctctcgaccgccgcaggacgcggtatattattagtgtgcgagactagttaggtggttagttcgaccttacgtccgtaccctaagtttacggtagtcggtaccggttcgtacggggaccgaaacggggccgtacgaacggttcccgtaacccgttccgttacccgtaccgaacccggtcccccttaaccccgaaacccgggtaaacccggggtacccccttaaacgggtttccccgggttaccccccgttttccccccgggtacccggggtcccccgttaacccccgtttccgggacccctttacccgggaaccggggtaaccctcccccgttaaccccggtacccggggtaaacgaccgaacccgtaaccccggggaaccgggtccccggggtcccccgggtacgggttccccgttaccgggtacccccgggtttagggtaacccgggtaaaccggttccccgttttaaacccccgttcccggtttacccggttaccccgttacccgtttaacgggacccgggttacgggccccgggggttacctacgggtacccggaacggg

SEQ ID NO: 147161 - DNA, 809 bp, Homo sapiens
  misc_feature: GYAE6OF02GQSUB.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcactgggctggatccgccagcccccagggaagggctggagtgggttgcgtagtattttcatgatgggaccacctactataggtcgtcgactacaacagtcgagtccaccatatccgtagaccgacgtccgaaggaaccagttcctcccgtagaacgtctagaaaccttcgtacctacgacccggtaccgacaacggaccgggtaccgggtaattaacgtttaagtttaagtttacggtggaccggaagtaacctaaagttaggttacggttaacgtttcgggaccttaacccggtccgtaccccgtttaagtttaaccgggtaagttccgggtaaccgttaccgggtacgggggtaacccgtaaacgggggacccctaccggtaacggttacccgtaacccgttaccgttaccccgttccgaaaccggtccccttaaccccgtaaacccgggaaaccgggtacccccgtaaccgttaccccgggtttccccctttacccccccggtacggggtcccccggttaccccccggtttacggtacccccgtttacccggaacggggtaacccgaccccggttaaaccccgtacccgggtaaccggaaccggtacccgtaaacccccggg

SEQ ID NO: 147162 - DNA, 615 bp, Homo sapiens
  misc_feature: GYAE6OF02GJFXM.21.70.G04.1.454.CMB.1.raw
  modified_base (396)..(396): a, c, t, g, unknown or other
  misc_feature (396)..(396): n is a, c, g, or t
  modified_base (602)..(602): a, c, t, g, unknown or other
  misc_feature (602)..(602): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggatccgccacgcccccgaggggaagggctgggaggtgggttgcgtagttatttttcagtgatcgggaccacctactataggtcgtcgctcaacagtcgagtcaccatactccgtagaccacgtccaaggaacctagttcctccctagaacgctgaacctctctcgacccgccgcgacgacggcggtatagtattagttgngacgagactagtagtggtattgggcttacgtccgtacccttagttacggtagtcggtacgtcgtcggggaccaacgggaccgcgacgttcctaccggttcctcccgtcgaccgccctaccgaccgaaccggccctacgttccgttcccttccccggtcggcccgcccgttcgcccgtaccggacggacgcccgaaccgtcccgganaccggcctaacgg

SEQ ID NO: 147163 - DNA, 725 bp, Homo sapiens
  misc_feature: GYAE6OF02ICESU.21.70.G04.1.454.CMB.1.raw
  modified_base (301)..(301): a, c, t, g, unknown or other
  misc_feature (301)..(301): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatctacgtcggggctggacgtccgccgacgcccccgaggggaacgggcgtgggacgtgggtgacggtagttattttcatgagtggaccacctactagtacggtcgtccgacttcaacgngtcgagtcaactagtactccgtagaccaacgtccaaggtaacctacgttcctacctagaacgtcgtaggtaacctctaccgtacgaccgtccgacgacggaccggtagggtaactaacttattagttagtcgacggagtaaccgtagttaggttacggttagttacggtacgttaccgttacgtacccgttagttaacgggttacgttacgggtacggttaccgggttccggggaaccgtaacggggaccgtacgaaccggtaccgtaccggtacccgtccgtaccgtccgcccgttacccgaacccggaaccggtacccgcggttacccgttcccttcccggtccggccgtaccccggtccgtcccgttaccgaccggtacgacccgtaccccggtaccggtaacggaccgtaccaacccggg

SEQ ID NO: 147164 - DNA, 613 bp, Homo sapiens
  misc_feature: GYAE6OF02FITGV.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgcgcagacgcgggtatatattattgtgcgagacatagtggtattggctactcgccctattacggtatggacgtcgtcggggccaaggggaccgcagtcaccgtctcctcacgcctccaccgaagggccccactccggttcctttccccccgtaggcccgtccccttacgccctcccgacggacgccacccttcccggacgacggccaaccacgccgggcccctgggcctcgcccgttggtaccgaacgggtaccttaccgttccccgtccggttcttcccgtaccgttcggaccggtcggggtccgttcgggacgtaaccgggg

SEQ ID NO: 147165 - DNA, 528 bp, Homo sapiens
  misc_feature: GYAE6OF02I6ACS.21.70.G04.1.454.CMB.1.raw
  modified_base (354)..(354): a, c, t, g, unknown or other
  misc_feature (354)..(354): n is a, c, g, or t
  modified_base (460)..(460): a, c, t, g, unknown or other
  misc_feature (460)..(460): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagccccagggaagggctggagtgggttgcgagtattttcatgatgggaccaccgtactataggtcgtcgctcaacagtcgagtcaccagtatccgtagacacgtccaggaaccagtctaccctgaagctgaacctctctgaccnccgcagacgcgggtatatattattgtgcgagacatagtggtatggctatcgcctattacggtatggacgtctggggcgaaggacggtcagtcaccgtctcctcgancctccaccgaggaccccatccggtcttccccctggccgccctcgcctcacggagccacctccgagacg

SEQ ID NO: 147166 - DNA, 795 bp, Homo sapiens
  misc_feature: GYAE6OF02IC45K.21.70.G04.1.454.CMB.1.raw
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtggggctggatccgccacgccccccgaagggaaggggcgtgggaggtgggttgcgtagttatttttcatgagtgggaccacctactataggtcgtcgctcaanagngagtcaccatatacgtagacacgtccaggaacctagttcctcctgaacgcttacgaactctctcgacccgccgacacggaccgacgttaggtataacgtttattaacgttgtgacgaagtaactagttaggttaggttaagtttggaccttaacgtcccgtaccccgtttaaagtttaccgggtaaggttacgggtaaccggttccggtcggggggtaacccggaaaaggggtaccccgaccggtacggttacccgtaacccggtttcctcccgtcgtaccggtccccttaccccgaacccggaaccgggacccgtaaccgttcccgggtttccccttacccccggtccgggttcccgtccccgtcgtacccgttacccgacggccgaccgtacccgtacccggacgaccgtaccgaccgaccgggtcccggtacccggccgggaccgtccggtaccggtccggttaccgaaccgggttacccgttaacccgttccccgttccgttccgttacgttaacccgtacggtaaccgggtccggcggtaccggtaacccggg

SEQ ID NO: 147167 - DNA, 1021 bp, Homo sapiens
  misc_feature: GYAE6OF02HE5C6.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggggtcggcccgacggacgtcgtggagacgttccggtaggacctcgtccgtcccacctcgtcactgtcgttctcggttgggcctccatacatactaactaggttcgtaacttaattaccacgtagggggtcggtgtaacgtcccgccccgaccggacccccggaccgggggaaagggggtaccggtggtagggttcgggggtttcggaccgtaagggtttaattttttaccgttagagtaacggttacggggtaacccgtaaccttaactttaacgttaaggggttccggttaccgtccgtacaaaaccgtacggttacgggtaccgtaaccaacccctaacgttaacgttaccccgggttaacgaacctacccggttacccggaaaccggaaaacccgttaaccgttttccggttccccctaaggaaaggtcccgttcggtaaaaacctttcctcggtaccggacccgggtccccgtacgaaaccggtaaccgggggtaaccgggtttaagtttaaacttaaagtttttacggtttagggtacgggtaacccgaaacgttaaaccggtaacgtttaagggtttaacgggtttaggtttacggttaccggttacgttaccccggtcccgttttaaacgtaacgggtttaacggtgggtaccggtcgggttaccggggacggtaaccggggaacccgtcgtacggtacccgaacccgtttccttaccgtaccccgtacggtcccctacccgtaaacccgaacccggggaccccgttaacgtcccgggtttaccccgttcccccgtttacccggggtccccggtaacccccgttccggtacccgttacccgaaacccggggtccgtaacccggttaccccggtacccgggtaaaccgggaccgtacccgaacccgggtaacccgggg

SEQ ID NO: 147168 - DNA, 634 bp, Homo sapiens
  misc_feature: GYAE6OF02HESXX.21.70.G04.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgccccgagggaagggctgggagtgggtgcgtagttattttcatgagtacgggacctacctactagtaggtcgtcgctacaactagtcgagtacaccatacgtcgtacgacaccggtaccgaacggaacctcgttacctaccgtagaacgtactacgaacttcgtactcggacccgaccgactacggacggtacggtattattattagttgngacgagactagtagtgtagttgactacgtcgtaccttagttaccggtagtacggtcgttacgcggggaccaacgggtacccgacgtactcgtaccgtcctaccgtcgaccgttcccacccgaaccggaccggccctcgtacccgttccctcccggtacgggcccctacccgtcgtacccgcgtacggaccgtccaccgtcggaacgccgacaccgg

SEQ ID NO: 147169 - DNA, 544 bp, Homo sapiens
  misc_feature: GYAE6OF02FZ4S7.21.70.G04.1.454.CMB.1.raw
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgaagccttcggagaccctgtccctcacctgcactgtctctggtggctccatcatcaatggtcattatcactggggctggatccgccagcccccagggaagggctggagtgggttgcgagtattttcatgatgggaccacctactataggtcgtcgctcaacagtcgagtcaccatatccgtagacacgtccaggaaccagttctccctgaagctagaacctctctgacccgccgcagacgtcggtatatattatgtncganacatagtgtattggctactcgcctatacggtntgacgttcgtgggcgaagggaccgcgagtaccaccgtacctcctcacgccctaccaccgacggcccagtccggtccttccccgtcggccgccctcgcctccgacggccgaccaccgttccgagaccg

SEQ ID NO: 147170 - DNA, 648 bp, Homo sapiens
  misc_feature: GYAE6OF02H5WTL.21.70.G04.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagcctttcggagaccctgtccctcacctgcactgtctctggtgctcatcatcaatggtcattancacgtggggctggactccgccacgccccgagggaacgggctggaggtgggttgcggtagttatttttcattggagtcgggaccaccttactagtacggtccgtcgctacaacgagtcgagtaccaaccatacgttccgtaagaccaccgtccgaacggaacctacgtttcctaccctaggaacgtctacgaaccttctcgtcgacccgcgcacgcgacggttatatagtttatgtagcgagactagtagtaggttattcggctactccgtaccttagttacggtagtggtacgtcggtacgggaccgaagggtaccgacgtacgtcccaccgttccgtccctacgaccgtccctacccgaaccgaccgggtaccctacgttcccgtacccgttccccgacggcccgtcccgtcgcccgttaccgacggtacctccgtaccccgtcgaacgccgaccgtaacccgg

SEQ ID NO: 147171 - DNA, 630 bp, Homo sapiens
  misc_feature: GYAE6OF02JO41G.21.70.G04.1.454.CMB.1.raw
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattactcacgtggggctggtatccgccacgcccccgaggggaacgggctgggacggttgggttgcgtagttagtttttcacttagagtcggaccaaccttatagtacggtcgtcgctcacgaggtcagtcacactagtaccgtagacaccgtccgaaggaacctacgttcctcccgttgaacgtcttacggaacttcctcgtaccgacccggtaccgtcgaacggacccggtacgggtattaacgttaattacgttggttacgacgagtacagtagtgtacttggccttacgtccgtcttaagtacggtagcggtacgttcgaggggccaacgggcacgntccgactcnccgtacncgcccgtacacggtaccgcctcgtccgtcccttccgcgggtcctccgtcgtacccgacgacgtacggccttaccggacctaggccgtacgaccgg

SEQ ID NO: 147172 - DNA, 830 bp, Homo sapiens
  misc_feature: GYAE6OF02IAEHS.21.70.G04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccagggaagggctggagtgggttgcgtagttatttttcattgatgggaccacctactataggtcgtcgctanaactagtccgagtcaccagtactccgtagacacgtacgaacggaaccagtttccaccctagaaacgctacgaactctacctggaaccccgcgacaagtaccggaccggggttaattaattatttaagttcggtaggaccgtaaggaacttaagttaaggttggttaattcgggacctaaccgttccggaaccctttaaaggttaccggtagtcggggtaaccgtttccggagggggtaaccccaaacgggggaacccgtcctaaggtcccaaccccgggtttcccttaccgtaccgaacgttcccctaacccccgaaccggaaaccgggtcccctaaacgttcccggttccccgttacccccggtgcccgttaccccgttgacccgttaccgaacgggacaccccgaaccgttacccggaaggcacccggtaaccaaccggggtcccggtaccccgggttagggccttagggtaccccgttacggggttacccgtaaaggtaccccgtttacccttttccccgttaccggtttaccttaacccggttaacgtttccgggaacggggtacccccggggtaactttaccggggaacccgtaaccggggg

SEQ ID NO: 147173 - DNA, 685 bp, Homo sapiens
  misc_feature: GYAE6OF02HS1YA.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggactccgccagcccccgagggaagggctggagtgggttgcgtagttatttttcatgatgggaccactactataggtcgtcgctcaacagtcgagtccaccatatccgtagacacgtccaaggaaccagttcctccctgaagctagaactctctacgaccgcccgcaacggaccggtacgggtaattagttaactttaagtggtgaccgagtacagttagtaggttattcggcttacctccggtacccttaagttaacggtatggggtaccgtcgtcggggggaccaaacggggccgacgtacggtccgaacccgttccttccctcgaccggtcctaccccgaacccgtaacgggaccctacggtaccggttcccttaccccgtccggccgccccgtcgccttaccgacggtacgaccaccgtccgaggcctaccgacgacggccgtcccgtcgggcctcggtccgtacgggtacgaacgggtccttaacccgttccctacgttcccgacttaccgtacggtacggccgggtctacggaccggtacgg

SEQ ID NO: 147174 - DNA, 855 bp, Homo sapiens
  misc_feature: GYAE6OF02J185M.21.70.G04.1.454.CMB.1.raw
tcagtcgtcgctcgcacgaccggtgctcgatttagtgtagtgtgaagggaaagggtctccgaaggcttcaccagtcctgggtcctgtcccagctgcagctgcaggagtcgggcccaggactggtgagccttcggagtaccctgtccctcacctgcacttgtctcgtggtcgactccactcattacaagtcggtctagttatcgacgtggggctgggactccgaccgccgaccccgagggacgggccgttgggaggttcggggtcgtaccggtagtttacgttttcgacgttagcggttaccggacccttaacggtacttaggttacgggtccggtccgtacgtaaccgtaaccggtacggtaccggtacttaacccggaacttaacggttaccgtaccggttaaccgaaccgtaccggttaaccgaaacggtaacccgtaccgtttaccgttacccgtacgtaaccggacgttacctaaccgtccgtaccttaacccggcgtaaccgtacgggtaccggtacggttattaagttaactttgttacggtacgtacggacttacggtaagttcggtagtttccgtaggtacccgttactacccgtttaccggttacggttaaccggtcggttccggtaaacggtccgggttaacgggaacctaccggggtacctacgtaccggtccgtacccgtctttacccgcgtacccgtccgtaacccgacccggtacggtaccctccgggttaccgttccccggtttcccggaccggttcccacccggttccgtaccccgggtaacgttacccgggaccgttaccccggtacggaaccccggttacgacccggttaaccccgg

SEQ ID NO: 147175 - DNA, 746 bp, Homo sapiens
  misc_feature: GYAE6OF02IHKEU.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcggcccaggactggtgaagccttcggagaccctgtccctcacctgcactgtctctggtggctccatcatacaatggtcattatcacgtggggctggactccgccacgccccgagggacgggcgtggaggtgggttgcgtagttattttacagtgagtcggacctaccttactagttaggttccgtcgtctaccgaactacgtcgtaacgtaccaaccgtaattacgtaccccgttaagtaaccgtaacccggttaccgaaacgggtaaaccctcgtttaccgtaccccgtagaaacggttccgtacgtaaccttcgtccgtaccgaccccggccgacgaccggtaacggtccggttaaataagttacgtttagtttaggtacggacggtacgacttaagtaggttaggttacgttcggttacctaccgttcgtacccgttaagtttaacggttcggttacggtacggttacggttacggggaaccggtaaccgggccgacggaccgttacccgaccgttaccttccgaccgcgtaccccgtaccgaacccggaaccggccaccgttaccgttccccttacccggtcgcccggtacccgtcgcccgtaccgacggtcgcctacccgaccggtacgacgtccgaccg

SEQ ID NO: 147176 - DNA, 626 bp, Homo sapiens
  misc_feature: GYAE6OF02GLJ99.21.70.G04.1.454.CMB.1.raw
  modified_base (279)..(279): a, c, t, g, unknown or other
  misc_feature (279)..(279): n is a, c, g, or t
  modified_base (397)..(397): a, c, t, g, unknown or other
  misc_feature (397)..(397): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggaaggggctggagtgggttgcgagtatttttcatgagtgggaccacctactataggtcgtcgctcaacacgtcgagtcaccatatccgtagacacgtccaggaaccagttcctccctgaacnctacgaactctctcgaccgccgcagacgcgggtatatattagtgtgcgagctagtagtggtattggcctactctccctaattacggtataggtacgtcgtgggggaccaaaggggccncgacgtccgtacccgtctcctcgacgtccctacccgacccgaacgggccctacgttaccggtcccttcccccgtcggccgtccctcggccgtccgacggtacgccacccgtccggtacgacgcgacgacggccggtacccggcggaccgtcgtccgtcggtaccgtaacgggtaccttaccgttcccgtcgttctaccgttcgtacggcggccgggcgtcggacgacgg

SEQ ID NO: 147177 - DNA, 997 bp, Homo sapiens
  misc_feature: GYAE6OF02GE0SF.21.70.G04.1.454.CMB.1.raw
  modified_base (500)..(500): a, c, t, g, unknown or other
  misc_feature (500)..(500): n is a, c, g, or t
tcagtcgtcgctcgcacgaccggtgctcgatttagtgtagtgtgaagggaaagggtctccgaagccttcggagaccctgtccctcacctgcatgtctctggtggctccatcatcaatggtcattatcgacgtggggactggactccgccacgccccgaagggaagggctgggaggtgggttgcgtagttatttttcgattggagtacgggacctaccttactagtacggtcgtcggctacgaaacgtagtacgacgttccaacctaattaacttccggtaacgacctaaccggtaccaaagggtaaacctacggtttcctacccgtaaggaacggtccttagaaaccttccttacgtacggacccgccggactaacggaccggtaacgggtaacttaagtttaacgtttaacgttggtcgaacggtaacgtacgtaagttaacggtggttaacgttcgggtaccttaccgtccgtaccccgttaagttaaccgggttacncgggtaaccgtttcgggtaacggggaacccggtaacgggaacccgtccgtaaacgggttcccgtaaccccgtttacgtaccccgtacgtaacccggtccccttaaacccggaaaccccgggtaaacccgggtcccgttaaacggtttcccccgttccccgggttaaccccccgttccgggaccccggttccccgttaccggtaccccggttaacccggacggggtaaccctttaccccgggaacccgtttaaccgggaaacggttaccggaaccccggaaaccggtacccggggtaacccccgggtacccgttacgggggtaccccttaccggggttaccccgggtttacgggtaaaccccggttaaaaacggggttcccccgtttaacccggttaaccccgttttcccggttaaccgtttaacccggttttacggacccggggtaaaccgggttccccggggttacggtaacgggggtaaacccttaacccggggg

SEQ ID NO: 147178 - DNA, 789 bp, Homo sapiens
  misc_feature: GYAE6OF02HPJHL.21.70.G04.1.454.CMB.1.raw
  modified_base (278)..(278): a, c, t, g, unknown or other
  misc_feature (278)..(278): n is a, c, g, or t
  modified_base (755)..(755): a, c, t, g, unknown or other
  misc_feature (755)..(755): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcacgtgggactggatcccgccacgcccccgaggggagggctggagtgggttgacggtagttactttttcagtgagtcgggacccaccgttaactagttacggtcgttcgcctcaaacgtgtacgtaggtaccacctataccgtaccggtanaccaccgtcaacggaacctagttcctcccgtagacgctaggaacctcctcgtcgacccgtcgaactacggacgtcgggtaacttagttactttagtgtcgacgtacgactaagtagttaggttatacggtcttaacctcccggtacctttaaggttacggtagtacgggacgtttccgggacgggaacccggtaacggggtacccgaccgtaacggttcccgaaccgtttccctcccggtaactcccgtacccacccgtaaccggaaccggtaccctacggtttcccgggtaccccttaccccggtcggtaaccccgttccccggtaccgtaccgacccgacggggtaccaaccccggtaccgtacccggtaaccgggcgtaccgaaccggtccggacccggtcccggaggtcccggaccttccgggtacgtacggtaaccgtcccgttacccgtcccttacgtcctaaccggttcncgggtacggccggtcgtaccgggacgtaaccggg

SEQ ID NO: 147179 - DNA, 761 bp, Homo sapiens
  misc_feature: GYAE6OF02JV6Z7.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcgggagaccctgtccctcacctgcactgtctcgtggtggctccatcatcaatggtcattatcacgtggggctggactccgccacgcccccgaggggaacgggctgggaggtgggttggcgtagttagtttttcagttagagtcgggacctacctagtacgtaggtcgtacgtcgtacaacgtcgtacggacgtccaacctaattacgtaccggtagaccgtaccgttaccgaacgggtaacctacggttccctacccgttaggaacgtcgtacgtaaccttccgtaccgttacggaacccgcccgacgaacggtaaccggtcgggttaattaagttactttaagttcggtacggacgtaaacgactaggttagttagggtatttacgggcctttaaccggttcccgtaccgtttaagtttaccgggtaagttaccggggttacggtcgggtttcgggggaacccgaaccggggtaccaccggaccggttataccccggtcttacccgtacgaaccgtcccgttacccgaaaccggtacccgtcccgtagttccccgtaccccgtttcccgcggaccctcccggtatcccggtacgtacggaccgccgtaaccgtcggaacgtccgactaacccggg

SEQ ID NO: 147180 - DNA, 697 bp, Homo sapiens
  misc_feature: GYAE6OF02HGJRK.21.70.G04.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctcatcatcaatggtcattatcactgggctggatccgcacgccccagggagggctggagtggtgcgtagtattttcgatgatcggaccactactagtaggtcgtcgctcaactagtcgagtcacctatactccgtanactacgtccaggaacctgttcctccctagaacgtctacgtactctacgtcggacccgcgcgagaccggtacggtattacgtacttacgttgtacgcgtaacgtacgtagtacgggttagtaacgttcgggacttacccgtaccggtcccttaagttacgggtagtcgggacgttcgtacgggggacaaaccggggtccacgtacgtccgtaacccgttcctaccgtcgtaacgtccccttaaccgaaccggtaacgggtaccctacggttcccggttaccccgtttaccccggtacgggtaccccggtacccccggttcgtaccccgttacccggaacggttaccgtaccccggtacccgtttacccccgggaagttaccgggacccctaacccgggg

SEQ ID NO: 147181 - DNA, 608 bp, Homo sapiens
  misc_feature: GYAE6OF02FQ0CN.21.70.G04.1.454.CMB.1.raw
  modified_base (365)..(365): a, c, t, g, unknown or other
  misc_feature (365)..(365): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtgctccatcatcaatggtcattatcacgtggggctggatccgccacgcccccgagggaagggctggagtgggttgcgtagttattttcagtgtagtcggacctaccgtactataggtcgtcgctcaacagtcgagtcaccatatccgtagaccacgtcccaggaacctaggttcctccctagaagctgaacctctctcgaccgccncaggaccggtacgggtatacgttaatttattggtacgcgagactaagtagtgtagttgctactcgtaccctagttacgtactggacgttcgtcgggacgaacgggccgcgtcggtcaccgtctccgtcacgtcctaccaaccgacggcccgtaagtcccggttacctccccgtacggcccgtcccgtccggtccctaccgtacggaccgaccgtacccgttacccgcggtacgcctaacccgg

SEQ ID NO: 147182 - DNA, 911 bp, Homo sapiens
  misc_feature: GYAE6OF02FQFK0.21.70.G04.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagtgtagtgtgaagggaaagggtctccgaagccgttcggagaccctgtccctcacctgcactgtctcgtggtgctccatcatcaatggtctattactcacgtgggctggactccgccaccgcccgagggagggctggtaggtgggtgcgtagtttattttcagttggagtcggtaaccaaccttacgtagttacggttccgtaccgcttacgaaacgcgtaccggtaacgtcctaaaccnttaaccgttaccggtaacgacccgtaaccgggttaacccgaagggtaaccccttacgttttacccctaccccgtaaggtaacgttacccgtacgtaacccgttccgtaccgtaacccggacccgcccggacccgaaagggtccgggtaaccgggttatttaacgttacgttttacgttggtacggaacgaacgtacgtagttaacggttagggttcgttacggtaccttaacgttccgttacccttaagttaccggggttatcgggtaccgtacgggtaccgggaaccgtaacggggtacccaggtaccttacccgtccgttccgtaccctaccgtaccgtccccgttaacccgaacccgggtaacccggacccgttacggttaccccgttaccccgttcccccggtaccgggccccgttcccgtaccgtacccgtaccgggaccgacccgttacccgaacccggttccggaacgtaccgaccgtaccgggacccggcccggtaccggtccggtacccgttcggttacccggtacgggttaacccggtaaccgttacccgttacccgtttaccccggtcgtttacccgttaccgtaccggttaggtcccgggtacggtcggtaccggaaccgtaccgg

SEQ ID NO: 147183 - DNA, 584 bp, Homo sapiens
  misc_feature: GYAE6OF02IGY7D.21.70.G04.1.454.CMB.1.raw
  modified_base (484)..(484): a, c, t, g, unknown or other
  misc_feature (484)..(484): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcacgtggggctggactccgccacgccccgaggggaagggctggaggtgggttcgacggtagtttatttttcagtggagtacgggaccaccttacgtagtacggtcgtcgctacaacgagtcgagtccactatactccgtagacacgtaccgaggtaacctgttcctcctagaacgtctagactctctacgacccgcacaggaccgaggttatattattattggtacgcgagactagtaggtgtagttgactactcgtaccttagttacgtgtacggacgttcgtgggaccgaacggccgngacgtacaccgttcctctcacgccctaccaccgacggcctacgtccgttcccgtcccgcgtccgccctgcctccgagccaccgccgtacgagccgcacgg

SEQ ID NO: 147184 - DNA, 796 bp, Homo sapiens
  misc_feature: GYAE6OF02INBZ1.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcggcccaggactggtgaagccttcggagaccctgtccctcacctgcactgtctctggtcgctcatcatacaatggtctattatcacgtgggctagctccgccacgcccgagggacgggcgtcggaggttggtgacggtagttacgttttacagtagagtcggaacctacctagtacgtacggtcgtcgtactaccgaacgtaggtacggtacgtaccacgtaactacgtaccgtaacgaaccgtaccgtaaccgtaacggaacctaggttccctaccgttacggaacgttacgtacgtaaccttccgtaaccgtcggtaaccccgccgaccgaaacggtaccgggttacggtaatttaaacgttacgttaacgtttcgtaaggtcgaacgtacgtagtacgttggtacttcgtactacgtctaaccgttagttaacggtgtacggtacgttcggaccgggaacgtaaccggcgttacgaccggtccttaacccgtccttacccgtacctaccggtacccctaccggtaaccccggtaaccggtccccgtttaagttcccccgtttacccgtccccccgggttacccggtcccggttacccccgtcggtttaccccggaccgtaaacccgggtcccggttaacccccttaaccccgggtacccggtaaccgaaccccggtaccggaacccccgggg

SEQ ID NO: 147185 - DNA, 711 bp, Homo sapiens
  misc_feature: GYAE6OF02GZ6IC.21.70.G04.1.454.CMB.1.raw
  modified_base (482)..(482): a, c, t, g, unknown or other
  misc_feature (482)..(482): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctcgtggtggctccatcatacaagtggtactattactcgacgtgggctggactccgaccacgccccgagggacgggcgtagggtaggtgggtcgacggtagtttacgttttcagtgagtcggacctactacgtagtacggtcgtcgtctaacaacgtacgtacgtacgtaccaaccgtagtaccgtaccggtaacgtaaccgtaccgttaaccggaaacggtaaccgttacgttacccgttaccgtaggtaacggtccgttaacggtaaccttccgttaccgaacgtacccggcgtacgacgtacggtacggtattacgttattagtgngacgagtactagtagtagtcgtggtcctactccgtcgttagttacgtagtacggtcgtggtcgggaccgacgggtccacgtacgtcgtaccggtcctaccgtacgaccgtcctaccgaccgacggtaccctacggttcccgtacccgttcccgccggtcccgtcccgttccgacccgttacggtacggacgttacccgtacccggtacgacgttacggacctacccggg

SEQ ID NO: 147186 - DNA, 693 bp, Homo sapiens
  misc_feature: GYAE6OF02GJF4C.21.70.G04.1.454.CMB.1.raw
  modified_base (324)..(324): a, c, t, g, unknown or other
  misc_feature (324)..(324): n is a, c, g, or t
  modified_base (408)..(408): a, c, t, g, unknown or other
  misc_feature (408)..(408): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatccgccagcccccgagggagggctggagttgggtgcgagttattttcatgatcgggacctacctactagtaggtcgtcgctcaacaggtcgagtcaccatacgtaccgtagaccacgtccaagggaaccagtttcctccctaggaagcctagaactctcgcgacccgcgccagaccgcggtatntattagttgtgcgagacagtaggtgtattggcttactccgaccttagtacggtatggaacgtcggtcggggaccaaggggaccncaggtccacccgttctccgtcgccgtcctacccgaacccgaacgggcccctacgtcccgggttaccctttccccccgtacgggtcccgtaccccgttcgtcccgtaccgacggtaaccgccgttaaccccgacggtacgaccggtacgaaccgtcggcccggtcccggtcgggaccttccgtaccgttccgggtacgtaaccgggtccgttaaccccgtttcccgtccggttccttaacgtccgttacggacgggtacccgggtccggtcggaccgtaacccggg

SEQ ID NO: 147187 - DNA, 598 bp, Homo sapiens
  misc_feature: GYAE6OF02GGLZP.21.70.G04.1.454.CMB.1.raw
  modified_base (273)..(273): a, c, t, g, unknown or other
  misc_feature (273)..(273): n is a, c, g, or t
  modified_base (593)..(593): a, c, t, g, unknown or other
  misc_feature (593)..(593): n is a, c, g, or t
tcagtcgtcgctcgcacgaccggtgctcgatttagtgtagtgtgaagggaaagggtctccgaagcccttcggagaccctgtccctcacctgcactgtctctggtggctccatcatcaatggtcattatcactgggctggatccgccagcccccagggagggctggagtgggttgcgtagtattttcatgatggaccactactataggtctcgctacaacagtcgagttacaccatatccgtagactaccggtccaggaacctagttcctcccngaagctagaacttctctgaccgtccgcacgacgcgggtaatatatttattgtggcgagacatagtggtattggctactcgacccttagttacggtatcggacttcgtagggcctaaagggccgacacgtccaccggtcctacctcgacgtccctccaaccggaacggcccacgttccggttccttcccccgtggcccgtccctcgcctccgacgggactccaccgtccgagtacgctaccgacgtcccgcccgtgggcctcgccgttggtacaaccgggaacttcccgtccctcgtactctacgcgaggccggcgtcggntacgg

SEQ ID NO: 147188 - DNA, 871 bp, Homo sapiens
  misc_feature: GYAE6OF02HD6HI.21.70.G04.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactgggctggatccgccacgcccccagggaaggggctggagtgggttgcgagttattttcatgagtcgggaccacctacgtataggtcgtcgctcaacngtcgagtcaccagtactccgtaagaccacgtaccgacggaacctacgtttcctccccgtaggaaacgtccgttagaaccttccgtacctcggaaccccggccggaccgaaggaccgggtaccggggttaattaacgttattttaggttcgtacggaccggaagtaccgtaagtagggtttagggttacgttcgggtaccttaaccgtcccgttacccgtttaacgtttaaccggggtagttcggggtaaccggtttcccgggtaggggggaacccgaaacgggggtacccgcgttaaccggtcccgtacccggttcctacccgtacgccgccccttacccgaaaccgaacccggggttccctacgtcccggtttccccgtaccccgtcgggtaccccgtcccgttcggacccgttccgggaacgtacccggacccctaacccgggtaccggaacgtacggtaccaaccgggtcccggcccgggtacccgggttcggaacccgttttccggaacccggttcgggttaaccgaaacccgggtttaccccgtttacccccgtttcccgggttacccgttacccttaccggttaacccgggtacggaacccggggtccggggtacccggtagggaaccccgaacgggg

SEQ ID NO: 147189 - DNA, 611 bp, Homo sapiens
  misc_feature: GYAE6OF02HKHW5.21.70.G04.1.454.CMB.1.raw
  modified_base (292)..(292): a, c, t, g, unknown or other
  misc_feature (292)..(292): n is a, c, g, or t
tcagtcgtcgctcgcacgaccggtgctcgatttagtgtagtgtgaagggaaagggtctccgaagccttcggagaccctgtccctcacctgcactgtctctggtggctccatcatcaatggtcattatcactggggctggatcccgccacgcccccagggaagggctggagtgggttgcgagttatttttcatgatgggaccacctactataggtcgtcgctacaacagtcgagtcaccatactccgtagacacgtccaggaacctagttcctccctgaagctagaacctctntcgacccgccgcagacgcgggtatattattattgtcgcgagacatgtggtattggctctccgccttattacggtgtaggtacgtcgtaggggaccgaacggggccgcgacgtccacccgttctcctcacgccctccacccgaacggccctacgtcccgttcccttcccccgtcggcccgtcccgtcgcccgttaccgacggcgaccctacccgccgacgacgaccacgacggcccggcccgtggccgtcgtccgtacggtacgtaccgttccttcccgttcgtctcctacgtcgtcggccggtcggtcggacgacggcg

SEQ ID NO: 147190 - DNA, 834 bp, Homo sapiens
  misc_feature: GYAE6OF02HOIQJ.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagtccttggagacctgtccctcacctgcactgtctctgggtgctccatcatctaatcgtctagttactcacggttggggccttagggacttccggaccgacgtacccccggaaggggaacgggtccgtagggtacggttcggggttagacggtagttttaacttttcgagttaggacgttccgggaacctaccttacgttaacgttacggtacggtccggtaccttaccgaaaccggttacgtacggtacgtacccgtaacctaacgtaaccgttccggtaacgaaccgtaccggtaacccgacgtaaaccggtccttaccggtacccctaaggaacgtcgttaccggtaaacttccgtactccggacccgccgtacgaacggtacggtacggttacgtaacgttacttagtttacgggacgtaacggaacgtactaaggttaggtcggtttacgttcggttactccgttaaccgttaccgttacgtttaacgtacggtacgttaccggttagggtaccgggaccggaacgggtacccgtaagtaccgtacctaccggttacctaccgacgtacccggtaccacccgtaccgggaaacccgtccgtacggttcccgggttacccctccgtacccggcccgtcccggttctacccgtaccgacgggtaaccctaccccgggtacgttaaccgggaccgtaacgtcccgtaacccgg

SEQ ID NO: 147191 - DNA, 872 bp, Homo sapiens
  misc_feature: GYAE6OF02I7WIT.21.70.G04.1.454.CMB.1.raw
tcagtcgtcgctcgcacgaccggtgctcgatttagtgtagtgtgaagggaaagggtctccgaagccttcggagaccctgtccctcacctgcactgtctctggtgctccatcatcaatggtcatatcgacgtggggctggactccgccacgccccgagggagggctggagtggtgcgtagttatttcatgagtcggacctactactagtacggtccgtcgctacaacgtagtcgaacgtcaccagtaccgtaccgtagaacctaccggttaccgaacgggtaacctacgtttccgtcccgtaagtaacgtcccgtagtaaccttactccgttacggaccccggtaccaccgtaagggtaccccgggtagggttttaaacttaagtttaacctttaggttaccggttacgggacgtaaacgggaactttaaagtaggggttaaccggttaaacggttcggtaacgtttaacccgtcccgtaccccgtttaaccggtaaacgggtttaggttccggtaacggtcccggttagggggaaaccccgaacgggaacccgtcctacgggtacctaccccgtccgtaccgtacgtaccgtacccctaaccgaccgtaaccggaccgtaccgtccgtccggttaccccgtaccggtccggtacccgttccgacctacccgtacggaccaccgtacccgttaccgaaccggttcgaaccgtcccgggtaaccgtccgggtaccccggtcgggtccgtccggttaccgttcccgggtaacggtaccggttaacccggtaacccgtttcccgttacccgttaccgtcccgttaacccgtttccggggaagggtacccggtcgggtacccggtacgtacccgggg

SEQ ID NO: 147192 - DNA, 811 bp, Homo sapiens
  misc_feature: GYAE6OF02HDYS1.21.70.G04.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtcgctccatcatcaatggtactattatcacggtgggctggactcccgaccacgcccgagggaacgggctgggaggtcgggttgacgtagttatttcgagtgacgtcggacctactacgtagtacggtcgtactacctacaacgtgtaccgagtaccaacgtataccgtccgtaacgaaccgtaccggtaccgaacggtaaccttacgttacctaccgtacggaacgtctaacggtaacctccgtaccgtacggaccccgngtaccgacggtaccggttacggtaactttaagttagtttacgtggtacggaccggtaactacgtaagtttacgggtttaggttacgttacggttaaccgttaccgttaccccgttaaccgttaacggtttaaaccgggtttaacggttacgggttaccggtttccgggtaaccggggtacccggaaacggggtccgaaccggtacgttacccgtacccgtttccaccgtaccgtaccgttacccaccgtaaccgggaaccggtacccgtaccggtttcccgggtacccctttccccggtacccggtcccgtcccggttaccggtacccgttacgaacgggtcccgtaacccggttacccggaccggtaccgaaaccgtcccggtaacccggg

SEQ ID NO: 147193 - DNA, 730 bp, Homo sapiens
  misc_feature: GYAE6OF02FYEGY.21.70.G04.1.454.CMB.1.raw
  modified_base (141)..(141): a, c, t, g, unknown or other
  misc_feature (141)..(141): n is a, c, g, or t
  modified_base (240)..(240): a, c, t, g, unknown or other
  misc_feature (240)..(240): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (519)..(519): a, c, t, g, unknown or other
  misc_feature (519)..(519): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtcccncacctgcactgtctctggtggctcctatcatcaatggtcattatcactgggctggatccgcacgtccccagggaacgggctggaggttggtgcgtagtnttttcagtgatcgggacacctacataggtcgtcgccgtcaacagtcacggtctacactactccgttaacgtacacgttaccaacggaacgtacttcgtacccttgaacgtctacgtaactcctacgtcgtaaccgccggcacgacggcggggtaaattactagtttaatttcggtaggtaccggtaanaccgtaagttgttaacgggtnttttacgggaccttaccgttacccggtcccctttaagttaacccgggttattacggggaaccggtttcgngggggacccgttaaaccggggacgtcctaaggtcccggtaacggtcccttacctaccgtacggtcccttacccggaccctaaacgggccccgttaacgtcccggtttaccctccccgtttacgggccccgttaccccggtactcccggtacccttaacgggggactacccggtaacccctttacccgggaacgtaccggaccggtacccgg

SEQ ID NO: 147194 - DNA, 803 bp, Homo sapiens
  misc_feature: GYAE6OF02G7IF4.21.70.G04.1.454.CMB.1.raw
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctcatcatcaatggtcattatcgacgtgggctggactccgccacggccccgagggaacgggctagggagtgggtcgcgtagttatttcagtgagtcggacctactactagtagtcgcgctacaanagtcgagtcacctatagtaccgtanaccgacgtaccaacggtaaacctcgttacctccgtacggtaacgaccgttacgaaaccttcctacgttacccggaccccggaccgccggtaaggaaccggtttagggtaaacttaagttaactttaacgttcgggtaccgtaacggtaacgtaacgttaagtttaacgggttaggtttaacggtttaccgggtaccgttaccggtttaacccggtaccccgtttaaacggtttaaccggtaggttacgggtacccgggttaacgggtacggggaccccggaaacgggtacccgtaacgtacggtaacccgtttacccgtaccgttccccgtacgtaacccgacccttacccggtaacccggaaaccggtaccccgttaacgttcccgttaccccgttcccggtccggccccggttcccgtaaccgtcccgttacccggaacgggtaccctacccgggaacccgtaccggtacggtaccacccggtaaccgg

SEQ ID NO: 147195 - DNA, 843 bp, Homo sapiens
  misc_feature: GYAE6OF02HVMGD.21.70.G04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccagggactggtagaacgccttcggagaccctgtccctcacctgcactgtctctggtggctcatcatacatgtcattatcacgtgggctggactccgccacgcccgagggacgggtntggaggtggtcgacgtagtttattttcatcggtagtacggacctaaccgttacgttacgtacggttccggtcgtactacgaaaccgtcggtaccgtacggttaccaacgtactttaccgttaaccggagtaaccccgaaccggttacccaaacgggtaacccttacggtttcccgtaccccttaagggaaccggtcttaaccgtaaaccttccgttaccgtacccggacccggtaccgcgtacgggtaccggtaaacgggttaacttaacgtttagtttaacgttcggtaacgggaacttaaggaacttaacggtttaggttacgggtttaacggtttacggtaccttaaccgttccggttaacccgtttaacgttaccggttacggttacggtaccgggttacggtaccggggtaaccggtaaccgggtacccgtacggtaaccgtaccgtacccggtccgttcccgtactacccggtaccctaacccgtaaccggaaaccggttacccgtaccgttacccggttcccccgtttcccggtacccgggtcccgacccgttccgtacccgtccggtaacgtaccggccgtacccgacggtaaccgaccgaccggtacccgg

SEQ ID NO: 147196 - DNA, 823 bp, Homo sapiens
  misc_feature: GYAE6OF02GIT0P.21.70.G04.1.454.CMB.1.raw
  modified_base (688)..(688): a, c, t, g, unknown or other
  misc_feature (688)..(688): n is a, c, g, or t
  modified_base (802)..(802): a, c, t, g, unknown or other
  misc_feature (802)..(802): n is a, c, g, or t
  modified_base (814)..(814): a, c, t, g, unknown or other
  misc_feature (814)..(814): n is a, c, g, or t
tcagtcgtcgctcgcacgaccggtgctcgatttagtgtagtgtgaagggaaagggtctccgaaggcttcaccagtcctgtcccagctgcagctgcaggagtcgggcccagggactggtagaacgtccgttcggacgacccttgtacccctcacctgacctatcgtctcgtgggtcggcctccatcatctaagtcggtactattatccgaggtggggtcgtacggacctccgaccccgaccggaccccgggaagggggtaacgggggtcgtcgggtaagggttcggggttacgtcggttaagtttttactttttacggacgttaggtaacggttaccggaaacccctaaccgtttaacgttaacggttacgggtaccggttaccgaccttaaacgtaacgtacggttcggtaacgtaccaacctaacgttacgtaccggtaaacgtacccgaccgttaaccggaaaccgggtaaccttcgttacccgtaccgtaaggaactccgttaacgtccttacgtccggtaccggaccgaccgcggaaccgacgggttacggtaatttacttaagtttacggtggagacgacgtaagtcggttaggtacgggttcgtacgtacgttacctccgtacgtttaaggtacgtggtcggtacggttcggacgggacggtaaccggcgacgtaccgtccncgtaccttacgcaccgtccaccggaaccgtaccgtaccgtccgttaccccgtcccgtccgaccgtcccgtaccgtccgtaaccggcggtacccgtaaccggccctacccgggtnccggtaacccgngtacccggg

SEQ ID NO: 147197 - DNA, 662 bp, Homo sapiens
  misc_feature: GYAE6OF02GHOHK.21.70.G04.1.454.CMB.1.raw
tcagtcgtcgctcgcacgaccggtgctcgatttagtgtagtgtgaagggaaagggtctccgaaggcttcaccagtcctgtcccagctgcagctgcaggagtcgggcccaggactggtgaagccttcggagaccctgtccctcacctgcactgtctctggtggctccatcatcaatggtcattatcgtacgtggggctaggatccgcacgcccgagggacgggctggagtgggtagcgagttactttcagtgagtcggacctacgtactatacggtcgtcgctcaacgtagtcgtagtccacctatacgtccgtagacctacgtccgaacggaacctagtttcctccctaggaagtccgtagtaaccgtctcctcgacccgccgactacgggacgtacggtacttaatatttacgtgtcgacgtagactagtaggtagttagtcggtactcgtccgtaccgttagtacggtgtacggtacggttcgtcggggaccgagggaccctcgtacgtaccgtaccgtcgtcccgtacgaccgtccctcccgaacccgtacgggtccctaccgttacccgttcccgttaccccgcccggtccgttaccccgtcgggtccccttacggacggacctccgacccggtacggacgtaccggtctaacccggg

SEQ ID NO: 147198 - DNA, 630 bp, Homo sapiens
  misc_feature: GYAE6OF02I7XZT.21.70.G04.1.454.CMB.1.raw
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
  modified_base (407)..(407): a, c, t, g, unknown or other
  misc_feature (407)..(407): n is a, c, g, or t
  modified_base (462)..(462): a, c, t, g, unknown or other
  misc_feature (462)..(462): n is a, c, g, or t
tcagtcgtcgctcgcacgaccggtgctcgatttagtgtagtgtgaagggaaagggtctccgaagccttcggagaccctgtccctcacctgcactgtctctggtgctccatcatcaatggtcattatcactggggctggatccgccacgcccccgagggaaggggctgggagtgggttgcgagttatttttcatgatggaccacctactatatgtcgtcgctcaacagtcgacgtccaccatactcgtanacacgtccaggaaccaggttcctcccgttagaacgctagtaacctctcctgacccgccgcaggcgcggtatactattagttgngcgatacataggtgtattgctacgtcgacctaagtttcggtatcgggtacgtcgtcggggaccgaacggggcccncgagttacccgaccgttactcccgtaccacgtccctccgaaccgaccgggtaccncgttccggtaccttcccccgtcggtacccgcccgtacggtccctccgacggacgccaccgtccgacgacgccacgacgccggccgtcggtccttccgtcggtacgacgtaaccgtacttcccgtaccgtcctccgtacgtaggccggcggacggttccggactacggg

SEQ ID NO: 147199 - DNA, 537 bp, Homo sapiens
  misc_feature: GYAE6OF01C0V2V.3.23.C01.1.454.CMB.1.raw
  modified_base (531)..(537): a, c, t, g, unknown or other
  misc_feature (531)..(537): n is a, c, g, or t
tcagagacgcactccacgaccggtgctcgatttagtacacgtgattagggagttggggcctcagtgaaggtctccctcgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctgggtcaccgtctcctcagccctccaccaagggcccagtccggtcttccccctggccacccctccctcccaacgacgccacctccgtcggggcacgagccggccctgggcctcggcctggtcaagggtactacttccgagtcgcgtctgagcgggcgtggcaaggcgcatacgnnnnnnn

SEQ ID NO: 147200 - DNA, 512 bp, Homo sapiens
  misc_feature: GYAE6OF01EJ835.3.23.C01.1.454.CMB.1.raw
  modified_base (433)..(433): a, c, t, g, unknown or other
  misc_feature (433)..(433): n is a, c, g, or t
  modified_base (506)..(512): a, c, t, g, unknown or other
  misc_feature (506)..(512): n is a, c, g, or t
tcagagacgcactccacgaccggtgctcgatttagtacacgtgattagggattggggcctcagtgaaggtctcctgaaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgttgcgaggacaatctgtgccggtgactgctacgtcgatttctggggccagggaaccctggtcaccgtctcctcagcctccaccaaggcccatcgtctcccctgcaccctcctccaagagcacctctcggggcacngccggccctgggctgcctggtcaaggactacttccgagtgccgtctctgagcgggctggcaaggcgacatagnnnnnnn

SEQ ID NO: 147201 - DNA, 579 bp, Homo sapiens
  misc_feature: GYAE6OF01BXJX9.3.23.C01.1.454.CMB.1.raw
  modified_base (574)..(577): a, c, t, g, unknown or other
  misc_feature (574)..(577): n is a, c, g, or t
  modified_base (579)..(579): a, c, t, g, unknown or other
  misc_feature (579)..(579): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccagggaaccctggtccaccgtctcctcacgcctccaccgacgggcccagtccggtccttcccccgtggccacccctcctacccaacgacgccaccgtccgtcggggccaccgacggccggccccgtgggcctcggcccgtcgggtaccgaacgggtaccttaccgttccggacgttcgccgttcgtcgtcggacggccggggctgggccgtacgggccgacgagtacgcnnnngn

SEQ ID NO: 147202 - DNA, 533 bp, Homo sapiens
  misc_feature: GYAE6OF01BQ4IU.3.23.C01.1.454.CMB.1.raw
  modified_base (527)..(531): a, c, t, g, unknown or other
  misc_feature (527)..(531): n is a, c, g, or t
tcagagacgcactccacgaccggtgctcgatttagtacacgtgattagggattggggcctcagtgaaggtctcctgcaaggcgtctggatacgacgtcagcaggacggtatatacactgggtgcgacaggcccctggacaaggccttgagtggatgggaataatcaaccctagtgatggtggcacaagctacggcaaaccagttccagggcacgagtcaccatgtcaagggacacggccgcgaacacagtctatttggaactgaagaatttgaaatctgacgacacggccgtgtacttattgtgcgaggacaatctgtgccggtgactgctacgtcgatttctggggcccagggaaccctggtcaccgtctcctcagcctccaccgaaggcccatccggtcttcccctggcaccctcctcccaacgacgcaccctctggggccacgacgcggcccgtgggctggccctggtcaacggtactacttccgagtcgccgtctctgacgcgggctggcaggccgcatacgnnnnngc

SEQ ID NO: 147203 - DNA, 759 bp, Homo sapiens
  misc_feature: GYAE6OF01BS2IF.3.23.C01.1.454.CMB.1.raw
tcagagacgcactccacgaccggtgctcgatttagtacacgtgattagggattggggagagctgctcagttaggacccagagggaaccatggaaacccagcgcagcttctcttcctcctgctactctggctccagactaccccggagaaatttcttttgacgcagtctccaggcaccctgtctttgtctccgaggggagagagccaccctctcctgcagggccagtccgagtgtcagcagcaaccacttacgcctggtaccagcagacgacctggccaggcctcccgaggcctcctcactcccagtcggtcacctacgtacccaacgacgggcccaacgtcggaccactccccgaagacctagggttccaaggtggaccgtagggttcgggtaccgtagggaaactacggtaacctttaccgaccttactaccaaccctagtaccgaggaccgtaaggaccgttagggaaccgtacccgtaaggtaaacgttacttttaggacctttaaggtttttaacttaccgtttacgttcgttacgtacgttaaggtttacgttagggtttaacctttaccgttaacgtttccggtttacgggttacgttaaacgggttttccggggaccgggttaaccgggggtaaaccgtaaacggggttacgggtaaacggttaaaccgtaacgtaaaaccgggtacggtttacgggtacggtacccggttaacggttacccgaaaccttacgtttcccgttcgtttacccg

SEQ ID NO: 147204 - DNA, 592 bp, Homo sapiens
  misc_feature: GYAE6OF01ETEUS.3.23.C01.1.454.CMB.1.raw
  modified_base (340)..(340): a, c, t, g, unknown or other
  misc_feature (340)..(340): n is a, c, g, or t
  modified_base (584)..(585): a, c, t, g, unknown or other
  misc_feature (584)..(585): n is a, c, g, or t
  modified_base (588)..(588): a, c, t, g, unknown or other
  misc_feature (588)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgnggggccagggaccctggtcaccgtctcctcacgcctccaccaagggcccagtccgtccttcccccgtcggccacccctccctcccaacgacgccaccctcgtcggggcaccgacggccggcccgtcgggcctcggcccgtcgggtaccgaaacgggtaccttaccgttcccggtaacgtcggaccgttccgtccgttcggacggccggggtccgtcgggacgtaacgggccgacgaacgtacgnncgngngn

SEQ ID NO: 147205 - DNA, 524 bp, Homo sapiens
  misc_feature: GYAE6OF01D7T2H.3.23.C01.1.454.CMB.1.raw
  modified_base (313)..(313): a, c, t, g, unknown or other
  misc_feature (313)..(313): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagcccaccctctcctgcagggccagtccgagtgtcagcagcaaccacttagcctggtaccagcagagacctggccaggctccaggctcctcatccatggtgcactccaacgngggcccacgtggcactcccagacaggttccagtggcaggtggtctggaacngacttcactcncacntcagcagacgtggacgcctagaacgtactttgacttaagtttactactgtctgtactagttatggttacttctacgttcgttgtctaagttcggcggcggacgaggtgacgtagtacaacgtatggtgctcgacactatcgtgtc

SEQ ID NO: 147206 - DNA, 551 bp, Homo sapiens
  misc_feature: GYAE6OF01BHQ0L.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggcctccaggctcctcatccatggtgcatccaacacgggccacgtggcatcccagacaggttcaggtggcaggtgggtctgggaacagacttcgactcgtcacctatcagcgagactggacgcctagaacgtactttgactagtttattactgtctgctagttatggtacttcgtacttcgttggtactagtttcgggcggtacgggtacgtaagggtggaagtacgtacgaaacggtacgtggtaggacgtgactaccgtactcgttgttaccg

SEQ ID NO: 147207 - DNA, 536 bp, Homo sapiens
  misc_feature: GYAE6OF01B13HV.3.23.C01.1.454.CMB.1.raw
  modified_base (339)..(339): a, c, t, g, unknown or other
  misc_feature (339)..(339): n is a, c, g, or t
  modified_base (531)..(536): a, c, t, g, unknown or other
  misc_feature (531)..(536): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccagggaaccctggtcaccgtctcctcacgcctccaccaagggcccatccggtcttccccctcggccaccctcctcccaagacgccaccctcctcgggggccacgacggccggccctgggcctcggcctgggtccaaggtacctacttccgagtcgcgtctctgacgcgggctggcaagggcgcatgnnnnnn

SEQ ID NO: 147208 - DNA, 541 bp, Homo sapiens
  misc_feature: GYAE6OF01AOG9U.3.23.C01.1.454.CMB.1.raw
  modified_base (535)..(538): a, c, t, g, unknown or other
  misc_feature (535)..(538): n is a, c, g, or t
  modified_base (540)..(541): a, c, t, g, unknown or other
  misc_feature (540)..(541): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctgacgacacggccgtgtattattgtgcgaggacaatctgtgccggtgactgctacgtcgatttctggggccagggaaccctggtcaccgtctcctcagcctccaccaagggcccatccggtccttcccctcggccacccctccctcccaacgacgccaccctctcgggggccacgacgccggccctgggcctcgcctggtcaacggtacctaccgttccgacgtcgccgtctcttgacgcgggctggcgacggcgcagtagnnnngnn

SEQ ID NO: 147209 - DNA, 576 bp, Homo sapiens
  misc_feature: GYAE6OF01BFN5D.3.23.C01.1.454.CMB.1.raw
  modified_base (402)..(402): a, c, t, g, unknown or other
  misc_feature (402)..(402): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagacgacctggccaggcctcccaggcctcctcatccagtggtcgcactccgaacgcgggccacgtggccacgtccccagacaggttcagtggcaggtggtctggaacagacttcactctacacatcagcagactggacnccgtagaagtcttgactagtttatacgtcgttctgtactagtatcgttacttcgtacgttcgttacggttacttaaggtttccgggacgggtaccggtacgtagggtacggtaagtacgtaacgaaacggtacgttacggtaggtactacggacctacgtactcgttgttaccg

SEQ ID NO: 147210 - DNA, 801 bp, Homo sapiens
  misc_feature: GYAE6OF01BN5NX.3.23.C01.1.454.CMB.1.raw
  modified_base (406)..(406): a, c, t, g, unknown or other
  misc_feature (406)..(406): n is a, c, g, or t
tcagagacgcactccacgaccggtgctcgatttagtacacgtgattagggattggggagagctgctcagttaggacccagagggaaccatggaaacccagcgcagcttctcttcctcctgctactctggctcccagactacccccggagaaattcttttgacgcagtctccaggcaccctgtctttgtctccgaggggagagagccaccctctcctgcagggccagtccgagtgtcagcagcaaccacttagcctggtaccagcagacgacctggccaggcctcccaggcctccgtcatcccagtggtcgccaatacccgaacacggggcccaacgtcggaccaacgtccccgaaggacctagggtttcaacggttgggacctagggtcggggtactgggaaaccnggtaacctttcgaaccgttcttaccgaacctagttaccgacgaccgaaggtaaccgtgggaacgtacccgtaggtaaacggtaaccgtttttaggacctttaaagggtttttaactttaaccgttcggtttaccgttacggttaaccgtaaacgggttttaacgtttaccggggtttaaccttttaccgttaacccgttttaccgggtttttacgggtttaacccgtttaacgggtttttacccgggggacccgggggttaacccggggtaaaccggttaaacgggggttacgggtaaacggtaaaccggtttaaccggaaaaacgggttaaaccggttcgggtaacgggtcgttacggaccttaaacccgtacgtttcccgttacggtttaccc

SEQ ID NO: 147211 - DNA, 612 bp, Homo sapiens
  misc_feature: GYAE6OF01CEO4Z.3.23.C01.1.454.CMB.1.raw
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagtccagggcagagtcaccatgtcaagggacacggccgcgaacacagtctattgaacttgaagaatttgaaaatctgacgacacggccgtgtattattgtgcgaggacaatctgtgcggtgactgctacgtcgatttcgtggggccagggaaccctggtcaccgtctcctcagcctcaccaagggcccatccggtccttccccgtgcctaccccgtcctacccaacgacgccaccctcgtcggggtccacgacgccggtcccgtcgggcctcggcccgtcggtaccgaaacgggtacccgttaaccgttacccggacggtcgtccggttaccgttccgttgggacggtccggggtccggtacgggaccggaaacggggtccgaccggtacggttaacggacgtnacgtgngtcg

SEQ ID NO: 147212 - DNA, 721 bp, Homo sapiens
  misc_feature: GYAE6OF01AYUOP.3.23.C01.1.454.CMB.1.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
tcagagacgcactccacgaccggtgctcgatttagtacacgtgattagggattggggagagctgctcagttaggacccagagggtaaccatggaaaccccagcgcagcttctcttctcctgctactctggctcccaggataccccggagaaattcgtttttgacgtcagtctcaggcaccctgtctttgtctccgagggganagagccacccgtcgtcctgcgacgggccgagtccgagtcgtcagcagcaaccncttagcctaggtaccagcacgagacctggccaggcctccgaggcctccgtcatccgagtcggtgcacgtccaacgacggccacgtggacctacgtcccgaggactaggtttcgacggtcggactagggtcgggtactacggaactaggtaccgttacgacttcgtaccaaccgtacgttaccgacggacaacggaaccgtacggaaccgtaccgtaacggtaacggttactttacggactttacgttttaacgttacgttaggttccgtagtacgttaacggttaacgttacgggttaacctttaccgtaaccgtttacgtttacggttaacttaacggtttaccggggaccgggtaccggggtaaccgtaaaggggtacggtaacggtaaacgttaaccggaaaacggtacgttacgggtacggtaccgtcgggacctaacccggtacttccggttcggttaccg

SEQ ID NO: 147213 - DNA, 601 bp, Homo sapiens
  misc_feature: GYAE6OF01DAEH0.3.23.C01.1.454.CMB.1.raw
  modified_base (340)..(340): a, c, t, g, unknown or other
  misc_feature (340)..(340): n is a, c, g, or t
  modified_base (594)..(595): a, c, t, g, unknown or other
  misc_feature (594)..(595): n is a, c, g, or t
  modified_base (598)..(598): a, c, t, g, unknown or other
  misc_feature (598)..(598): n is a, c, g, or t
  modified_base (600)..(601): a, c, t, g, unknown or other
  misc_feature (600)..(601): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaaagggacacggccgcgaacacagtctatttggaactgaagaattttgaaatctgacgacacggccgtgtattatgtgcgaggacaatctgtgccggtgactgctacgtcgatttcgnggggccacggggaaccctggtcaccgtctcctcacgccctccaaccgaacgggccccagtccggtccttcccccgtcggtccctacccctccctacccaacgacgccacccgtccgtcgggggccaccgacggccgggcccgtcggggccgtcggcccgtgggtaccgaacgggtaccttaccgttccggacgtcggtccgttcctcgtcggtacggccggggtccgtgggacgaacgggccgacgacgtacgnncgngnn

SEQ ID NO: 147214 - DNA, 530 bp, Homo sapiens
  misc_feature: GYAE6OF01B3S4A.3.23.C01.1.454.CMB.1.raw
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (411)..(411): a, c, t, g, unknown or other
  misc_feature (411)..(411): n is a, c, g, or t
  modified_base (524)..(527): a, c, t, g, unknown or other
  misc_feature (524)..(527): n is a, c, g, or t
  modified_base (529)..(530): a, c, t, g, unknown or other
  misc_feature (529)..(530): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaaccagttccagggcagagtcaccatgtcaagggacacggccgcgaacacagtctatttggaactgaagaatttagaaatctgacgacacggccgtgtattatgtgcgaggacaatctgtgcgtnactgctacgtcgattcgngggcagggacctggcacgtctcctcacgcctccgacacggcccagtccgtccttccccgtcggccaccctccnccgaacgacgccacctcgtcggggcacgacggccgccgtcggctgccgtcggtcaggtactaccgtccgagtcgcgtctcgtcgacggcgggcgtggcgaggcgacgagtagnnnngnn

SEQ ID NO: 147215 - DNA, 863 bp, Homo sapiens
  misc_feature: GYAE6OF01DAML5.3.23.C01.1.454.CMB.1.raw
  modified_base (201)..(201): a, c, t, g, unknown or other
  misc_feature (201)..(201): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaatttcttttgacgcagtctccaggcaccctgtctttgtctccgagggganagagccaccctctcctgcgagggccagtccgagtgtcagcagcaaccacttagcctggtaccagcagacgacctggccaggcctcccgaggcctcctcactccagtggtcgcactaccaacgacgggcccaacgtcggaccacgtaccccgaaggaccgtaggttccaaggttcggactagggtcgggtactagggaaactacggtaacctttaccaaccgtttcctacccgaaccctacgttaccgaacgaccgtaacggtaaccgtacgggtaaccggtacccggttaagggtaaaacggtttaccgttttacgggaaccgttttaagggtttttaacctttaacccgtttcgggttaccgtttacggtaaccggttaagggttttaacggtttaaccgggtttaacccttttaccggttaaccgtttttaccgggttttaaccgggtttaacccgttttaaaccggggtttttccccggggggaacccgggggttaacccggggttaaaccccggttaaaaggggggttccggtaaaaccgggttaaaccggttaaaccggtaaaaacccgggttaccgggtttacggggtaaccgggttaacccggttaccggtaacccgtaaacccggttacgtttcccggttcgggttttaccccg

SEQ ID NO: 147216 - DNA, 536 bp, Homo sapiens
  misc_feature: GYAE6OF01ALU9T.3.23.C01.1.454.CMB.1.raw
  modified_base (339)..(339): a, c, t, g, unknown or other
  misc_feature (339)..(339): n is a, c, g, or t
  modified_base (532)..(536): a, c, t, g, unknown or other
  misc_feature (532)..(536): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccaggggaaccctggtcaccgtctcctcagcctccaccaagggcccatccggtcttccccctggccacccctccctcccaacgacgccaccctccgtcgggggccaccgagccggccctgggcctcgcccgtgggtccaaggacctaccttccgagtcgcgtctctgagcgggctggcaggcgcatagnnnnn

SEQ ID NO: 147217 - DNA, 628 bp, Homo sapiens
  misc_feature: GYAE6OF01DC4GW.3.23.C01.1.454.CMB.1.raw
  modified_base (343)..(343): a, c, t, g, unknown or other
  misc_feature (343)..(343): n is a, c, g, or t
  modified_base (623)..(624): a, c, t, g, unknown or other
  misc_feature (623)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaaccagttccagggcagagtcaccatgtcaagggacacggccgcgaacacagtctatttggaaactgaagaatttgaaatctgacgacacggccgtgtattattgtgcgaggacaatctagtgccggtgactgctacgtcgatttcgnggggccaggggaaccctgggtccaccgtctcctcacgccctccaccaagggccccagtccggtcctttcccccgtcggccacccctccctacccctaagaacgccacccgtcgtcgggggaccaccgacggcccgggccccgtcggggcctcggccctgggttaccgaaacgggtaccttaaccgtttccccggacggttacggtccgtttccgtcgtcggtaacggccgggggccgttacggggaccgtaaacggggccgtaccgaacgttagacgagnngngn

SEQ ID NO: 147218 - DNA, 601 bp, Homo sapiens
  misc_feature: GYAE6OF01CS7EG.3.23.C01.1.454.CMB.1.raw
  modified_base (594)..(594): a, c, t, g, unknown or other
  misc_feature (594)..(594): n is a, c, g, or t
  modified_base (596)..(597): a, c, t, g, unknown or other
  misc_feature (596)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattatgtgcgaggacaatctgtgccggtgactgctacgtcgatttcgtggggccagggaaccctggtcaccgtctcctcacgcctccaccaagggcccagtccgtccttcccctcggccaccctcctcccaacgacgccacctcgtcgggggccacgacgccgggcccgtcgggccgtcggcccgttcgggtaccgaaacgggtaccgttaccgtttcccgggaacggttcggtccggttccgtccgttcgggacggtccgggggccgttacggggccggaaacgggccggacgaaggtacgnanngngn

SEQ ID NO: 147219 - DNA, 571 bp, Homo sapiens
  misc_feature: GYAE6OF01CMSNE.3.23.C01.1.454.CMB.1.raw
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
tcagagacgcactccacgaccggtgctcgatttagtacacgtgattagggattgggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaaagggacacggccgcgaacacagtctatttggaactgaagaatttgaaatctagaaccgacacggccgtagtattatgtgcgaggacaatctgtgccggtgactgctacgtcgatttcgnggggcagggaccctggtcaccgtctccncacgcctaccaccgaagggcccatccggtccttccccgtcggccacccctcctaccgaacgacgcacctcgcggggcacgacgccggccgtcgggctcgccgtaggtcgaacggcctacgttccgagtcgtccgttctcgtcggtacggtccgggtacgtgggaccgaaacgggccgacgtagtacggacngctgngtc

SEQ ID NO: 147220 - DNA, 612 bp, Homo sapiens
  misc_feature: GYAE6OF01DCZIM.3.23.C01.1.454.CMB.1.raw
  modified_base (607)..(609): a, c, t, g, unknown or other
  misc_feature (607)..(609): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctgacgacacggccgtgtattattgtgcgaggacaatctgtgccggtgactgctacgtcgatttcgtggggccaggggaaccctggtcctaccgtctcctcacgcctccaccgaacggcccagtccggtccttcccccgtcggccacccctccctcccaacgacgccacccgtcgtcgggggaccacgtacgcccgggcccgtcgggccgtcggcccgttcgggtaccgtaacgggtaccttaaccgttcccggacggttcggtcccggttccgttccgtcggacgggccggggtccgtagggacccgaaacggggccgacgaacgtacggctgnnngcg

SEQ ID NO: 147221 - DNA, 537 bp, Homo sapiens
  misc_feature: GYAE6OF01B1HMR.3.23.C01.1.454.CMB.1.raw
  modified_base (408)..(408): a, c, t, g, unknown or other
  misc_feature (408)..(408): n is a, c, g, or t
  modified_base (528)..(528): a, c, t, g, unknown or other
  misc_feature (528)..(528): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggcctcccaggcctcctcatccatggtgccatccgaacgagggcccacgtggcactccccaagactaggttcaggtggcaggtgggtctagggaacagtacttcgacttcgtcactatcagcagacgtggancctagaacgtactttgacttagtttatactgtctgctagtagtcgtacttctacgttcgttgtactaagttcggcggcggacgaggtgagtatacgaaacgtcgtgtaggctcgacactntcgtgtacc

SEQ ID NO: 147222 - DNA, 563 bp, Homo sapiens
  misc_feature: GYAE6OF01BUHXZ.3.23.C01.1.454.CMB.1.raw
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (427)..(427): a, c, t, g, unknown or other
  misc_feature (427)..(427): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(561): a, c, t, g, unknown or other
  misc_feature (559)..(561): n is a, c, g, or t
tcagagacgcactccacgaccggtgctcgatttagtacacgtgattagggattggggcctcagtgaaggtctcctgcaaggcgtctggatacgacgtcagcaggaggtatatacactggggtgcgacaggcccctggacaaggccttgagtggatgggaataatcaaccctagtgatggtggcacaagctacgcaaaccagttccagggcagagtcaccatgtcaagggacacggccgacgaacacagtctatttggaactgaagaatttgaaatctgacgacacggccgtgtattattgtgcgaggacaatctgtgccggtnactgctacgtcgatttcgnggggccagggaaccctggtcaccgtctcctcacgcctccacaacggcccagtcgtccttccccgtgccaccctcctccaacgacnccgacctcgtcggggccacgacgccggcccgtgggcctcggccgtcggtaccgaacgggtaccttaccgttccgagttcgaccgttctcgtggacggtccgggcgtgggacgacggcgacgagtacgnancnnncg

SEQ ID NO: 147223 - DNA, 551 bp, Homo sapiens
  misc_feature: GYAE6OF01CRVWH.3.23.C01.1.454.CMB.1.raw
  modified_base (369)..(369): a, c, t, g, unknown or other
  misc_feature (369)..(369): n is a, c, g, or t
  modified_base (545)..(548): a, c, t, g, unknown or other
  misc_feature (545)..(548): n is a, c, g, or t
  modified_base (550)..(551): a, c, t, g, unknown or other
  misc_feature (550)..(551): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgaacgacacggccgtgtattatgtgcgaggacaatctgtgccggtgactgctacgtcgatttctggggccaggggaaccctggtcaccgtctccncacgcctccaccaggcccatccggtcttccccctggccaccctccctcccaagacgccaccctcgtcgggggccacgagcccggcccgtcgggcctggcccgtggtccgaacgggtaccttacttcccgagtcgccgttctcgtggacgcgggccgtgggcgaacgggcgcagtgnnnngnn

SEQ ID NO: 147224 - DNA, 559 bp, Homo sapiens
  misc_feature: GYAE6OF01BVOP1.3.23.C01.1.454.CMB.1.raw
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctccaggctcctcatccatcggtncatccaacgngggccacgtggcactcccagacaggttcagtggcaggtgggtctggaacagacttcactctcaccatcagtagcctagagcctagaagtatttgctagtacttattattgtacaacgtagcgtgacaacgtcggcccgtcgtcggtaccgttcggaccgaacgggaccgtaaggtacggaaacgtaccgaaaccgtaacgtcggtcggacgtaggacctaccgtacgttacttcgttcttcgtaccg

SEQ ID NO: 147225 - DNA, 700 bp, Homo sapiens
  misc_feature: GYAE6OF01B82SE.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggcaccctgtctttgtctccgaggggagagacgccaccctctcctgccagggccagtccgagtgtcagcagacaaccacttacgcctggtaccagcacgacgaccgtcggccgacggcctcccgacggccgtcctcactcctagtcggtcgccactaccaacgacgggaccgaccgtacggaccacacccttttttttacgaccgtacggtacgtacgtggacgtaggtacgggtcgtacggaacgtacgtacgttactaccgtactacctacctactacgtacgacgacgacgtacggtacgtacgtagtaacgtacgttacgtacgttaagtttaacgtttacgtacgtacgaacgtacgtaagttaacgttaacgtttaacgttacggtaccggtacggtaccggttacggtaaccggaacgggtaaccgtaagggtaacggtaaacgtaaccgtaaacgtaacgtacggtacggtacgtacgtaccgtaccgtacgtacgttagttcttccgtacgttacccg

SEQ ID NO: 147226 - DNA, 592 bp, Homo sapiens
  misc_feature: GYAE6OF01C5RMM.3.23.C01.1.454.CMB.1.raw
  modified_base (339)..(339): a, c, t, g, unknown or other
  misc_feature (339)..(339): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (589)..(589): a, c, t, g, unknown or other
  misc_feature (589)..(589): n is a, c, g, or t
  modified_base (591)..(592): a, c, t, g, unknown or other
  misc_feature (591)..(592): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattatgtgcgaggacaatctgtgccggtgactgctacgtcgatttcgnggggccaggggaaccctggtccaccgtctcctcacgccctaccaccgaacgggcccacgttccggtccctttcccccgtcggcccacccctccctacccaacgacgccacccgtcgtcgggggccaccgacggcccggccccgtcgggccgtcggcccgtcgggtaccgaacgggtaccttaccgttcccgtaggtcgtcgtctcgtggacggccgggcgtgggcgaacgggccgacgagtacgngnngngnn

SEQ ID NO: 147227 - DNA, 533 bp, Homo sapiens
  misc_feature: GYAE6OF01B5BGT.3.23.C01.1.454.CMB.1.raw
  modified_base (339)..(339): a, c, t, g, unknown or other
  misc_feature (339)..(339): n is a, c, g, or t
  modified_base (527)..(527): a, c, t, g, unknown or other
  misc_feature (527)..(527): n is a, c, g, or t
  modified_base (529)..(530): a, c, t, g, unknown or other
  misc_feature (529)..(530): n is a, c, g, or t
  modified_base (532)..(533): a, c, t, g, unknown or other
  misc_feature (532)..(533): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccagggaaccctggtcaccgtctcctcagcctccacaggcccatcgtcttcccctcgcaccctcctccaagcgcacctcgtcggggcacgacgcggctcgtcgggttcgccgtggtcgaacggtactaccgttcgacgtcgcgtctcgtgacggcgggcgtggcgaacgggccgcgacgtacgnanngnn

SEQ ID NO: 147228 - DNA, 530 bp, Homo sapiens
  misc_feature: GYAE6OF01CPMXC.3.23.C01.1.454.CMB.1.raw
  modified_base (342)..(342): a, c, t, g, unknown or other
  misc_feature (342)..(342): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (490)..(490): a, c, t, g, unknown or other
  misc_feature (490)..(490): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(530): a, c, t, g, unknown or other
  misc_feature (529)..(530): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtagtattattgtgcgaggacaatctgtgccggtgactgctacgtcgtatttcgnggggccagggaaccctgggtccaccgtctcctcagccctccaccgacggccagtccgtcctccccngccaccctccacagcgcacctcgngggcacgacgccgccgnggctcgcgtcggtcgaacgtctacgtcgagtcgcgtctcgnggacggcgggcgtggacgacggccgacagtacgnanngnn

SEQ ID NO: 147229 - DNA, 575 bp, Homo sapiens
  misc_feature: GYAE6OF01B2IJE.3.23.C01.1.454.CMB.1.raw
  modified_base (570)..(575): a, c, t, g, unknown or other
  misc_feature (570)..(575): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccaggggaaccctgggtccaccgtctccctcacgccctaccaaccgaacggggcccctaagtcccggttccttccccccgtcggcccacccctccctcccaacgacgccaccctcgtcggggccacgacggccggcccgtgggcctcggccgtcggtccgaacggtacctaccgttccgagtcgccgtctcgtgacggcgggcgtgggcgagggccgcgagtacgnnnnnn

SEQ ID NO: 147230 - DNA, 561 bp, Homo sapiens
  misc_feature: GYAE6OF01COHEY.3.23.C01.1.454.CMB.1.raw
  modified_base (302)..(302): a, c, t, g, unknown or other
  misc_feature (302)..(302): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtncatccaacagggccacgtggccatccccaggacaggttcaggtggcaggtcggctaggaacagactcactctcaccatcagcagacgtggacgccctagaaacgtctttgactaagttttatactgtctgactagtagttcggttaacttctacttcgttggttactaacggtttcggcgggtcgggaaccgtaagggtggaacgtataccgaaaacggtacgttggcggtacgtcgactaaccgtatcgttcgttacc

SEQ ID NO: 147231 - DNA, 587 bp, Homo sapiens
  misc_feature: GYAE6OF01BTB86.3.23.C01.1.454.CMB.1.raw
  modified_base (582)..(587): a, c, t, g, unknown or other
  misc_feature (582)..(587): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctagacgacacggcgtgtattattgtgcgaggacaatctgtgccggtgactgctacgtcgatttcgcggggaccagggaaccctggtccaccgtctcctcacgccctaccaccgaacgggcccagttccggtccttcccccgtggcccctaccctccctaccaacgactccaccgtcgtcggggccaccgacgcccggcccgtcgggccgtcgccgtcggtacgaacggtacccttaccgttccggacgtcgacgttccgtacgtcggacggccgggtccgtcgggacgaacgggccggacacgtacgnnnnnn

SEQ ID NO: 147232 - DNA, 560 bp, Homo sapiens
  misc_feature: GYAE6OF01EAAEN.3.23.C01.1.454.CMB.1.raw
  modified_base (342)..(342): a, c, t, g, unknown or other
  misc_feature (342)..(342): n is a, c, g, or t
  modified_base (548)..(548): a, c, t, g, unknown or other
  misc_feature (548)..(548): n is a, c, g, or t
  modified_base (553)..(556): a, c, t, g, unknown or other
  misc_feature (553)..(556): n is a, c, g, or t
  modified_base (558)..(559): a, c, t, g, unknown or other
  misc_feature (558)..(559): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctagacgacacggccgtgtattattgtgcgaggacaatctgtgccggtgactgctacgtcgtatttcgngggggcagggacctggtccaccgtctcctcacgtccctccaccgacggccctagttccgtcccttccccgtcggccctacccctccctaccaacgcgcctaccgtcggtcggggccacgcggccggcccgtgggcctcgccgtggacgacggtacctacgttccgagtcgccgtctcgtgaggcgggtcgtcggacgacggccganagtgnnnngnng

SEQ ID NO: 147233 - DNA, 758 bp, Homo sapiens
  misc_feature: GYAE6OF01DC0AU.3.23.C01.1.454.CMB.1.raw
  modified_base (392)..(392): a, c, t, g, unknown or other
  misc_feature (392)..(392): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccagatacccccggagtaaattcttttgacgcagtctccaggcaccctgtctttgtctccgaggggagagacgcccaccctctcctgcgaggccagtccgagtgtcagcagcaaccacttagccgtggtaccagcaggacgaccgtggccacgggcctaccgaggtcctcctcatctactgactgccactaccaacgcgggcccagtcggctactccgagtcccgaggttccgaggtcggacgtaggttcggggttacgnggggtactaggtaccttaccaccgttacctacgtaccctaagttcccgaacggttacgtacccgtaaggaccgtacccgttaaggtaaacgtttaacgttttcggaacgtttaacggtttactttaaagttttacgtttacgtaaccgttaaacgcgggttaccggtacggtaacccgtaaccggttccgggtaccccgttacgggtacgggttaacccggttccggggaaacccggtaaacggggtaacccggtaaacggggttaaacggtaaaaccggttaccgaaaacccgggtaacgttcgggttacgggacccgtttaaccggaacccgtacgtaccggttaccttggttccctttacccg

SEQ ID NO: 147234 - DNA, 574 bp, Homo sapiens
  misc_feature: GYAE6OF01DSFFL.3.23.C01.1.454.CMB.1.raw
  modified_base (339)..(339): a, c, t, g, unknown or other
  misc_feature (339)..(339): n is a, c, g, or t
  modified_base (568)..(569): a, c, t, g, unknown or other
  misc_feature (568)..(569): n is a, c, g, or t
  modified_base (571)..(574): a, c, t, g, unknown or other
  misc_feature (571)..(574): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaaatctgacgacacggccgtgtattattgtgcgaggacaatctgtgccggtgactgctacgtcgatttcnggggccagggaaccctggtcaccgtctcctcacgcctccaccgaaacgggcccagtccggtccttccccccgtggccacccctccctcccaacgacgccaccctcgtcggggccacgacgccggcccgtgggcctcgccgttgggtaccgaacgggtaccttaccgttccgtaggttcggtctccgtggacgtcggggcgtcgggaccgaagggccgacgtagtacgcnngnnnn

SEQ ID NO: 147235 - DNA, 569 bp, Homo sapiens
  misc_feature: GYAE6OF01CQXRC.3.23.C01.1.454.CMB.1.raw
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (564)..(569): a, c, t, g, unknown or other
  misc_feature (564)..(569): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcggcaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccagggaaccctggtcaccgtctccncagcctccaccaacgggcccagtccgtccttccccctcggccacccctccctcccaacgacgccacccgtcgtcgggggccaccgacggccggcccgtcgggccgtcgacccgtcgggtaccaacgggtaccttaccgttcccgagtcgaccgttcctcgtggacggcggggctgggacaagggccgcagtacgnnnnnn

SEQ ID NO: 147236 - DNA, 735 bp, Homo sapiens
  misc_feature: GYAE6OF01EDTE9.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagccaaccacttagcctggtaccagcagacgacctggccaggcctccaggcctcctcatccagtcggtagctaactcccgaacgtacggggacccaacgtggaccagtacccccaaggtaccgtacgggtttccaacggttgggacccgtagggttcggggtaccgttagggaaaaccagggttaacccttttcgaaacccttttctacccgaaccctaaagttccgtaacgaccgaacggtaaccgtacgggtaacgtaccccgtagggtaaacgttaccgttttacggaaccgtttaaggtttttaaccttaacgtttcgttccgttaggtaccgttaaggttacgtttcgggtttaaaccttttcgtaaccgttttcgttttacgggttaccttaacggttttccggggaccggtacgggtaaaccgtaagggtacggtaacgtacgttaacgaaacgtaagttcgtaggactcgactactgttcgtgttaccg

SEQ ID NO: 147237 - DNA, 573 bp, Homo sapiens
  misc_feature: GYAE6OF01AQFNW.3.23.C01.1.454.CMB.1.raw
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccagggaaccctggtcaccgtctcctcagccctccaccaacgggcccatccggtccttcccccgtcggccacccctccctccccaagacgcctaccgtccgtcgggggccaccgaggcccggcccgtcgggcctcggcccgtggtccaagggtacctaccgtcccggagtcgccgttcgtcgtcggaggccgggcgtgggcgaacgggccgcgacgtaggcngcngngn

SEQ ID NO: 147238 - DNA, 670 bp, Homo sapiens
  misc_feature: GYAE6OF01DXO45.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagacgcccaccctctcctgcagggccagtccgagtgtcagcagccaaccacttagcctggtaccagcagagacctggccaggcctaccgaggcctcctcgacttccgagtcggtgccatccgaacgacgggcccacgtcggccactcccaaggacctagggttcagggtcggacgtagggttgggtacctagggaaactacggtaacctttccgaactttccgtaaccaaccctagttaccgaagcctaacggaacgttgggaactcccgtaggtaaacgttctttggacttaaggtttttacttacgtagttcctagtccgtaagttacgttcggttaccttacgtacgttcgttcggttacttaaggtttccgggacgggtaccgggtaaccgaggggttacggacgtaaacgtaaccgtaacggtaacgtggttcggactcgacccgtactagtttcgtacgttacc

SEQ ID NO: 147239 - DNA, 583 bp, Homo sapiens
  misc_feature: GYAE6OF01B95WY.3.23.C01.1.454.CMB.1.raw
  modified_base (568)..(568): a, c, t, g, unknown or other
  misc_feature (568)..(568): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggcctccaggcctcctcactccatggtgcatcccaacgacgggccacgtggacactccccgaagactaggttccaggttcggctaggttcgggtactagggaaacaggtacctttcgaccttctaccacctatccgagcagacgtggacgcctagaacgtactttgacttagtttatacgtgtctgactagttatggttacttcacttcgttgtacttaagtttccgggacggtcggaaccgtagggtgaagtacgtaacgaaacggtcgtggtacgtcgtacgactaaccncgttcgtcggttacc

SEQ ID NO: 147240 - DNA, 578 bp, Homo sapiens
  misc_feature: GYAE6OF01AFLU3.3.23.C01.1.454.CMB.1.raw
  modified_base (372)..(372): a, c, t, g, unknown or other
  misc_feature (372)..(372): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctccaggctcctcatccatggtgccatccaacgagggcccacgtggcactcccagacaggttcagtggcagtggtctggaacagacttcactcncacatcagcagactggacgcctaggaacgtacgtttgacgttagtttacttacgtgtctgtctagttacttcggtacttcgtacttcgttacggtacttaacgtttcgggaccgggtaccgggtaccgtaagggtggaacgtacgttaaccgaaacggtacgttaggtaggtacgtacgaccctaccgtacttccgttgttacccg

SEQ ID NO: 147241 - DNA, 774 bp, Homo sapiens
  misc_feature: GYAE6OF01DN3CU.3.23.C01.1.454.CMB.1.raw
  modified_base (233)..(233): a, c, t, g, unknown or other
  misc_feature (233)..(233): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggcaccctgtctttgtctccgaggggagagacgccaccctctcctgcagggccagtcagngtgttagcagctacttacgcctggtatcaacacgaaacctggccaggcctcccgaggcctcctcatctatgatcgacactaccgaacgacgggcctaacgtcggaccacgtaccccgacgtaccgtagggtttccaggttcgggcgtaaggggttcgggggtaccgtaggggggaacctacgggtaccctttaccgacccttaccgttacccaaccccgtaagttaccgtaagggtaaccgtacccgtaaggaccgtaccgttaaggtaaacgtttcgttttacgacgttaacggtttactttaagttttaacttaggttaacctaaacgttacggtcggttacggtaaccttaacccgggttcgggtaccccgttacggggttaccgggtaccggttaccgggtaacccggaacggggtaaccggtaaaggggttaaccgaaacgtaccggtaaaacccggtaacggttcgggtacggtaccgtaccggaccctaaccgtacgttaccgttacgtttccctttacgtaccgtttcccccg

SEQ ID NO: 147242 - DNA, 550 bp, Homo sapiens
  misc_feature: GYAE6OF01EF3TS.3.23.C01.1.454.CMB.1.raw
  modified_base (199)..(199): a, c, t, g, unknown or other
  misc_feature (199)..(199): n is a, c, g, or t
  modified_base (356)..(356): a, c, t, g, unknown or other
  misc_feature (356)..(356): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccacttagcctggtaccagcagagacctggccaggctccaggctcctcatccatggtgcatccaacagggccactggcagtcccagacaggttcagtggcagtggctggaacngacttcactctcacatcagcagactggagcctagaagtactttgctagtttatactgtctgcagtatggtacttcacttcttggtctaagtttcgggcggtacgggtaccaaagggttggaagtacgttaacgaaaacggtaacgttcgggttacggacgttcggaccgtaacccgtagttccgttaggttccc

SEQ ID NO: 147243 - DNA, 844 bp, Homo sapiens
  misc_feature: GYAE6OF01ET005.3.23.C01.1.454.CMB.1.raw
  modified_base (363)..(363): a, c, t, g, unknown or other
  misc_feature (363)..(363): n is a, c, g, or t
tcagagacgcactccacgaccggtgctcgattttagtacacgtgattaagggagttggggcctcagtgaaggtctcctgcaaggcgtctggatacgacgtcagcaggaggttatatacactgggtgcgacacggcccctggacaaggtccttggacgtggatgggaataatcaacccgtaggtgagtggtggcacaagctacgcaaacctcgttccaggcagagtcaccatgtacgaacgggaccacggccgacgaactacgtagttcttagttaggaactgaagtaatttagaaatcgtagacgacgacggtcgttagtattagttgtaggacgaaggtaacaagttctaggtcgccggtanactgtactacgtacgtacgtttcggacggggaccaacgggtaccctggtaccctaccgtctccgtcacgtcccctacccgaaccggaaccgggtcccctaacggttcccgggttaccccgtttccccccgtacggtaccccgtacccccgttacccgttaaccccgaaacgtaccggtacccgttaacccggttcccggggttacccggggggaccctaacccggacccgggtaccccgggtaccccggttacggggtacccgttaccgggttacccgggttaccggggttaacccggtaaaccggggttaacccggtttaacccgggtttaccccgggttaaccgggttaccgggtacccggtttaccggttaccgggttaccggggaaccgggtcccgggggttaccgttaccggggtaccggtaaccggggtacccgggttaaccgaacggttaccggcggttacgacgtcgcgtacg

SEQ ID NO: 147244 - DNA, 664 bp, Homo sapiens
  misc_feature: GYAE6OF01A936V.3.23.C01.1.454.CMB.1.raw
  modified_base (201)..(201): a, c, t, g, unknown or other
  misc_feature (201)..(201): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggcctcccagatacccccggagaaatttcttttgacgcagtctccaggcaccctgtctttgtctccagggganagagcccaccctctcctgcacgggccagtccgagtgtcagcagccaaccacttagcctggtaccagcagagacctggccaggcctccgaggcctcctcatcccatcggtcgcactcccgaaacgcggggcccaacgtcggcctaacgtccccgaagacctagggttccaaggttcggactagggtcgggtactagggaaacctaggtaccttcgacttccgtaccactatcaagcaagactcgggaatccctaggtaaacgtacctttggaccttaagttttacttacgtgtactgactaagttacgttcggtaacctttcacgtttcgtttacgggtacttaacggtttccgggacgggtaccgggtaacgtaacgggtaggtaacggtaacgttaaccgaaaacgggttaacttgggttacggaccgttacgaccgtaacctaacgttccgttagttaccc

SEQ ID NO: 147245 - DNA, 765 bp, Homo sapiens
  misc_feature: GYAE6OF01BZD77.3.23.C01.1.454.CMB.1.raw
  modified_base (199)..(199): a, c, t, g, unknown or other
  misc_feature (199)..(199): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccagatacccccggagaaattcttttgacgcagtctccaggcaccctgtctttgtctccgagggganagacgccaccctctcctgcgagggccagtccgagtgtcagcacgacaacctacgttagccgtgggtacccagccaagacgacctggccaggcctcccgaggcctcctcactccctagttcggtcaccaactcccgaaacgacgggtcccacgtcggacctacgtccccaaggaccgtagggttccaaggtcggacgtagggttcgggtactaacgggaacctagtaccttacgaccttccgactaaccgtactacgaagaccgaagaccgttggaacgtccgtaaggtaacgtaccgtttagaccgttaagttttacgtacgttcgtacgtacggttacttaaggttacgtttaccgggttaacctttacccggtaccgttttacgtacgttaaccgtttaacgttaaccgggtttacccggggaaccgggttaaccggggttaaaccgtaaacgggggttacggtaaacgtaaacccggttaaccggtaaaaccgggttaccgtaacggggttaccggtaccgttacggaaaccccttaccggttacgtttacccggtttaccgg

SEQ ID NO: 147246 - DNA, 733 bp, Homo sapiens
  misc_feature: GYAE6OF01CUBF1.3.23.C01.1.454.CMB.1.raw
  modified_base (315)..(315): a, c, t, g, unknown or other
  misc_feature (315)..(315): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcacctgtctttgtctccaggggagagagccaccctctcctgcagggccagtccgagtgtcagcagtcaaccacttagcctggtaccagcagagacctggccaggcctcccgaggccttaccctcaactcccaagttcgggnaccaacgtcccgaaacggacggggccaacgtcggaccacgtccccgaagtaccctagggtttaccaaggttcggaccgtaggtcggggttactaacgggaaaccgtaaggtaccctttcaccgttccttacgaaccctatccgaagaccgaacggtacgtaggaaccgtccgttaggaaacggttacgtttaggacctttaaggttttaacgtttaacctgggttaccttacgtaccgttaagttatttaacgggttaccttaccttacgtttcgtttacgggtaccgttaaacgttttccggggaccgggttaacggggtacccgtaaagggttcgggaaagtaaacgttaccgaaaaacggttacgttcgggtaaccggtacctacggtccgtaaaccctgttccgtcggtttacc

SEQ ID NO: 147247 - DNA, 559 bp, Homo sapiens
  misc_feature: GYAE6OF01APCFO.3.23.C01.1.454.CMB.1.raw
  modified_base (553)..(553): a, c, t, g, unknown or other
  misc_feature (553)..(553): n is a, c, g, or t
  modified_base (555)..(557): a, c, t, g, unknown or other
  misc_feature (555)..(557): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctgacgacacggccgtgtattattgtgcgaggacaatctgtgccggtgactgctacgtcgatttcgtggggccagggaccctggtccaccgtctcctcacgccctccgaccaacgggccccagtccggtccttcccccgtggaccacccctccctacccaacgacgccaccgtcgtcgggggaccacgcgccggcccgtgggcctcggccgtcggtacgaaggtacctacgttccgacgtacgcgtctctcgacgcgggtctgggcgacggcgcagtacgnannngc

SEQ ID NO: 147248 - DNA, 593 bp, Homo sapiens
  misc_feature: GYAE6OF01DJWG2.3.23.C01.1.454.CMB.1.raw
  modified_base (344)..(344): a, c, t, g, unknown or other
  misc_feature (344)..(344): n is a, c, g, or t
  modified_base (587)..(587): a, c, t, g, unknown or other
  misc_feature (587)..(587): n is a, c, g, or t
  modified_base (589)..(591): a, c, t, g, unknown or other
  misc_feature (589)..(591): n is a, c, g, or t
  modified_base (593)..(593): a, c, t, g, unknown or other
  misc_feature (593)..(593): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttagaaatctagacgacacggccgtagtattattgtgacgaggacaatcgtgtgcggtgactgctacgtcgatttcgnggggccacgggaccctggtcaccgtctcctcacgcctccaccgacggcccacgtccggtcccttccccgtcggcccacccctccctacccgaacgacgaccacccgtccggtcgggggccaaccgacggcccgggtcccgtcggggtcctcggcccgttcgggtaccgaacgggtaccttaccgttccggtagtcggtcgtcctcgtggacggccgggcgtgggcgaagggcgaccgatacgnannngn

SEQ ID NO: 147249 - DNA, 760 bp, Homo sapiens
  misc_feature: GYAE6OF01AJLDH.3.23.C01.1.454.CMB.1.raw
  modified_base (744)..(744): a, c, t, g, unknown or other
  misc_feature (744)..(744): n is a, c, g, or t
tcagagacgcactccacgaccggtgctcgatttagtacacgtgattagggagttggggaggagctgctcagttaggacccagagggaaccatggaaaccccagcgcagcttctcttcctcctgctactctggctcccagactacccccggagaaattcttttgacgcagtctccaggcaccctgtctttgtcctccgaggggagagagcccaccctctcctgcagggccagtccgagtcgtcagcagcaaccacttagcctggtaccagcagagaccgtggccaggcctccgaggcctacctccactcccgagttcggtcgctacctccgaaccgacgggcccacgtggaccacgtaccccgagaccgtagggtttccaggtcggaccgtagggtcgggtacctagggaaaccacggttacccttaccaccgtttacccgccctaaaccgtacgttaaccgacggtaccgaacggtaccgtacgggtaaccgtccctaggtaaaccgttcgttttacggaccgtttaagtttttaaccgttaaccgtttcggttccgtttacggtaacgttaaggtttacgtttaacgggtttaacctttacccgtacgtttaccggtttacggttaccgtttaaacggtttcccgggggtaccgggacgggttaaccgtaacggggtaggtaacggtaccgttaacgtaaacggtacgttcggttacggtaccgttcgtacccgtaaccgttnttcccgttaggtaccc

SEQ ID NO: 147250 - DNA, 609 bp, Homo sapiens
  misc_feature: GYAE6OF01BFT0G.3.23.C01.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtacaagggacacggccgacgaacacagtctatttggaactgaataatttgaaatctagacgacacggccgtagttattattgtgcgaggacaatcgtgtgccggtnactgctacgtgtatttacgngggaccacgggaaccctggtccnccgtctccncncgcctaccgacgacggcccagttcccgtccttcccccgcggtcccaccctccctacccgaacgacgccacccgtcggtcggggccacgacggcccgccgtcggctcgtccgtcggtaccgaacgtaccttaccgttaccggtacggtcgtccgtccgtcgtacggtacggtcgggtccgtgggaccggtaaacggggccctacggaacgttcggagtnacgtcgngcg

SEQ ID NO: 147251 - DNA, 579 bp, Homo sapiens
  misc_feature: GYAE6OF01AD3G7.3.23.C01.1.454.CMB.1.raw
  modified_base (372)..(372): a, c, t, g, unknown or other
  misc_feature (372)..(372): n is a, c, g, or t
  modified_base (574)..(578): a, c, t, g, unknown or other
  misc_feature (574)..(578): n is a, c, g, or t
tcagagacgcactccacgaccggtgctcgatttagtacacgtgattagggattgggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctagacgacacggccgtgtattattgtgcgagacaatctgtgccggtgactgctacgtcgtattcgcggggccagggaccctggtccaccgtctcctcncgccctccgaccgacgggcccacgtccggtcccttccccgtcggccctacccctccctaccgaacgaccgccgtacccgtcggtacggggccaccgacggccggacccgtgggccttcggccgtacggcaacggtcctacgttccgacgtcgccgttcgtcgtcggacggccggtcgtcggacgacggccgtacacgtagcnnnnng

SEQ ID NO: 147252 - DNA, 644 bp, Homo sapiens
  misc_feature: GYAE6OF01CCQ0O.3.23.C01.1.454.CMB.1.raw
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (644)..(644): a, c, t, g, unknown or other
  misc_feature (644)..(644): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaacagttccagggcagagtcaccatcgtcgaagggacacggccgcgaaaccacgagtctagtttggaactagaanaatttagaaatcagacgacacggccgtgtacttatgtgcgaggactaatctgtggtcgtgactgcgtacgtcgattcgngggaccgagggaaccctggtcctaccgtctcctcacgtccctaccgaacgaacggtcccagtacccggttcccttcccccgtggtcccctaccccgtccctacccgtaaacgacgaccctaccgtcggtacggggaccaccggacggccgggtacccgtgggtcccgttcggtcccgttacgggtaccggtaaccggtaccgttaacccgttcggtacggtccgaccggttccgtcgtcggtacggccgggtcgacgggaccgtaacgggtccgaccgtagtacgctancgntcgn

SEQ ID NO: 147253 - DNA, 605 bp, Homo sapiens
  misc_feature: GYAE6OF01EG5OZ.3.23.C01.1.454.CMB.1.raw
  modified_base (310)..(310): a, c, t, g, unknown or other
  misc_feature (310)..(310): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagagccaccctctcctgcagggccagtccgagtgtcagcagcaaccacttagcctggtaccagcagacgacctggccaggcctcccaggcctcctcactccagtgggtcncactaccgaacgacgggccacgtggcactcccgagacaggttcagtggacaggtgggtctaggaacagtacttcactctacacctatcgacgcagacgtggacgcctagaacgtactttgacttagtttatacgttgtctagtactagttacgtcggttacttactacgttcgtttacggtacttaacggtttccgggacgggtaccgggtaaccgtaagggtgggtaacgtacgttaacggaaacggtacgttgggtacggacgtacggaccaccgtagttccgtgtttacccg

SEQ ID NO: 147254 - DNA, 604 bp, Homo sapiens
  misc_feature: GYAE6OF01BD057.3.23.C01.1.454.CMB.1.raw
  modified_base (372)..(372): a, c, t, g, unknown or other
  misc_feature (372)..(372): n is a, c, g, or t
  modified_base (599)..(599): a, c, t, g, unknown or other
  misc_feature (599)..(599): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgtatttcgtggggccagggaaccctggtccaccgtctccncacgcctccaccgaagggcccagtccggtccttccccgtcgccacccctcctacccaacgacgccaccctcgtcggggccacgacggccggcccgtcgggcctcggccgtacgggtccgaacggtacccgttaccttacccgtacggtcgtaccggttccgtccggacggtccggggtaccgtcgggtaccgaacggggtcccgacgtacgttacggactcgagcgngcgag

SEQ ID NO: 147255 - DNA, 736 bp, Homo sapiens
  misc_feature: GYAE6OF01C77CR.3.23.C01.1.454.CMB.1.raw
  modified_base (195)..(195): a, c, t, g, unknown or other
  misc_feature (195)..(195): n is a, c, g, or t
tcagagacgcactccacgaccggtgctcgatttagtacacgtgattagggagttggggcctcagtgaaggtctcctgcaaggcgtctggataccgacgtcagcacggaggtatatacactgggtgccgacgacggcccctggacaaggccttagagtggactgggaataatcaaccctagtcgatggtggtccanaagctacgacaaaccagttaccagggcagagtcaccatgtcaagggacacggccgacgaacacagtactatttggaactgagaatttgaaatcgtagacgaaccgacggaccgtagtatattgtgcgagactaatctagtgcggtagacgtgctacgtacgtattcgacgggcgaacgggaacccgtggtaccgtaccggtcctaccgtctaaccgcccttaccccaaccgtaacgggacccctaagttcccggttacccgttccccccgtccggtacccgtaccccctaccccgtaccccgtaaacgtaacggtacccgtaaccccgttaccggtaccgggggtaccctaaccgtaccggacccggtaccccgtacgggtccgttaccggtacccgttaccggtaccgtaaacgggtaccgttaaccggttcccggtaacggttccggtaccggttaccgtaccgtacgggtacgggtccggggtaccgtacgggtacggtaccgggacgtaccgacgttacggactgtacgtgcgtacg

SEQ ID NO: 147256 - DNA, 644 bp, Homo sapiens
  misc_feature: GYAE6OF01A4LD4.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaatttcttttgacgcagtctccaggcaccctgtctttgtctccgaggggagagacgcccaccctctcctgcgacgggccagtccgagtgtcagcagcaaccacttacgcctaggtaccagcagacgacctggccgaggcctcccgaggtcctcctcactcccagtggtcacacgtccaacgcgggccaacgtcggaccactcccgaagaccgtaggttccgaggtggcgtagggtcgggtctaacgggaactaggtaccttccacgttcctacgacctatccgagcgaagacgtggacgccgtaaggaacgttacttagtacgttagttttacgtacgtgttactcgtacgtagttagttcgttacttacgacgtttcgttaggttacttaacgggtttccgggccggggtacggtaaccgtagggtacgggtacgtacgtaacggtaaacggtcgtggtacggtcgtacgacctacgtacgttcgtcggttac

SEQ ID NO: 147257 - DNA, 729 bp, Homo sapiens
  misc_feature: GYAE6OF01B3377.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcacctgtctttgtctccaggggagagacgccacctctcctgcagggccagtccgagtgtcagcagcaaccacttagcctggtaccagcagagacctggccaggcctcccaggcctcctcatcccagtcgggtcgcacgtacccaagacggggcccaacgtcgggaccaactccccgaaggaccgtagggttccaggtgggctaagggttcgggtctagggaaaccaggtacgtttccaacttcctaccgtaaacccagttaccgaacgtccgtaaacggaccgttacggggacgtacccgtaggtaaacggttacgttttacgtaccgtttaagttttaactttaccgttggtccttacggtactaagttacgtttcgggttaacctttcgtaccgtttacgtttacgggttaccgttaacggttttccgggaccgggtaccgggtaaccggttaaacgggttaggtaacggtaacgttaaccgaaaaccggttacggttacgggttacggaccggttacggtaccctaaaccgtcgtttccgttcgtttacccg

SEQ ID NO: 147258 - DNA, 605 bp, Homo sapiens
  misc_feature: GYAE6OF01EFRHU.3.23.C01.1.454.CMB.1.raw
  modified_base (294)..(294): a, c, t, g, unknown or other
  misc_feature (294)..(294): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagcccaccctctcctgcagggccagtccgagtgtcagcagcaaccattagcctggtaccagcagagacctggccaggcctcccaggcctcctnacttccagtggtgcactccgaaacgacgggccacgtggaccagtccccaagacctagggttccaaggtcggactagggttgggtacctagggaaacctaggtacctttcaacgtcctacaccattcagcagacgtggacgtcctaggaagtacgtttgacttaagttttactacgtgttactgctagttagtcgttaaccttcgtaacttcgttaggtactaagtttccgggcgtacgggtaccgtaagggtgacgtactacgaaacggtcgttacggtcggactacggacctaacgcttccgtgttaccc

SEQ ID NO: 147259 - DNA, 569 bp, Homo sapiens
  misc_feature: GYAE6OF01A5OKG.3.23.C01.1.454.CMB.1.raw
  modified_base (455)..(455): a, c, t, g, unknown or other
  misc_feature (455)..(455): n is a, c, g, or t
  modified_base (556)..(556): a, c, t, g, unknown or other
  misc_feature (556)..(556): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggtccagtccgagtgtcagcagcaaccacttagcctggtaccagcagagacctggccaggcctcccaggcctcctcatcccatggtcgcactcccaacgacgggccacgtggcactcccagacaggttcagtggactaggtggtctagggaactacgtacttcaccgttctaccaacctatccgagcgagacgtaggacgcgtagaagtactttagacttagtttactacgtcgtntgactagtagtcgttacttacgtacttcgttgtactagttcggcggtacgggtactagggtaggagtacgtacgaaacggtacgtggtggctacgactacngttcgtcgttacg

SEQ ID NO: 147260 - DNA, 816 bp, Homo sapiens
  misc_feature: GYAE6OF01ESKTQ.3.23.C01.1.454.CMB.1.raw
  modified_base (312)..(312): a, c, t, g, unknown or other
  misc_feature (312)..(312): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagacgccaccctctcctgcgagggccagtccgagtgtcagcagcaaccacgttacgcctggtaccagcagagacctggccaggcctccgaggcctcctcactccagtcggtnccaacgtccgaaacgacgggcccaacgtggccaactccccaaggacctaacgggtttccgaacggttgggaccctaaggggttcggggtaccgtttagggaaaacccgacggttaacccttttccgaacccgtttacctaaccctaaccccgtaactttaccgacgaccgtaaacggtaccgttacggggaaccgttacccgttacggtaaacggttacccgtttttaggtaaccgtttaacggttttttaactttaaccgtttacggtttaccgttacggttaacccgttaaggtttaacgttacgggttttaacctttaccgttaaccgttttaccggttttacgggttaaccgtttaaccggttttccggggaacccgggtaccggggtaaccgttaaggggtacgggtaaacgtaacgttaaccggtaaaaccggtacggtttagggtacgggtaccgttaccggtacccgaacccgttcgttaccgttcggttaacccg

SEQ ID NO: 147261 - DNA, 731 bp, Homo sapiens
  misc_feature: GYAE6OF01EKNHW.3.23.C01.1.454.CMB.1.raw
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtacaagggacacggccgacgaacacagtctattggaactagaagtaatttagaaatctgacgacacggccgtgttacttattggtgacggtaggactaatcgtgtgccggtgactgactacggtcgtagttttcgcggggaccaggggaaccctcgggtacctaccgtcctacccgtcgaccgtcccgtacccgtaaccgaaccgggtcccctaaggtttccccgggttccctttccccccgacggtcccctacccccgttccccttaacccgtaaacgtaccgcccgtaacccgtttccggggtacgggggtaccctaccgggtaaccgggtccccgggtcccggttcgggggtcccttacgggcccgttacggggtacccgtaaacgggttaccctttaaccgttccggaacggtccggttacccggttccgttacggtccgggtaacggtcccggggtacggtccggggacgaacggggccttccggaagtaccgtncgtagngngc

SEQ ID NO: 147262 - DNA, 777 bp, Homo sapiens
  misc_feature: GYAE6OF01A5F1Q.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagacgacctggccaggcctcccaggctcctcactccagtggtgcatacccgaacacggggaccacgtggccacgtccccgaagtaccgaggttccaaggtggacctaagggtcggggtactaggggaaactacggtaacctttccgaaccgtttccgtaccaacccgtaagttaccgaacgaccgtaacggtaccgtacgggtaaccgtacccgttaagggtaaaccggttaaccgtttttacggaccgtttaaacggtttttaacgtttaaccgttacggtttccgtacggtaacgttaacgggtttaactttacgggtttacccttttaccgtaaccgtttccgttttacgggttacgttaaacggtttttccggggaaccgggttacccgggggtaaaccggttaaacggggttacgggaaacggtaacgttaacccgtaaaacgggttaaccgttacgggttagggtaccgttacggaccctaacccgtacgttccgttacgtttacccg

SEQ ID NO: 147263 - DNA, 755 bp, Homo sapiens
  misc_feature: GYAE6OF01DL1JD.3.23.C01.1.454.CMB.1.raw
  modified_base (748)..(748): a, c, t, g, unknown or other
  misc_feature (748)..(748): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggccctggacaaggccttggagtggatagggaataatcaacctagtgagtggtggcacaagactacgacaaaccgagttccgagggcaggagtccacatcgtacgaagggacacggccgacgaactacgagtactaagtttcggaaacgtgaaagtaatttacgaaatcgtagaacgacaacgggtctgtaattagttcggtgacggaaggtaacaatcgtaggtcgtccggtagtacgtcgtacgttacgtcgtaagttttcggacggggtacccacgggggtaaccctagggtcccgtaacccggtttcgtcccgtaactaccggtacccccgtaccgtaaaccccgaacggggtcccctaacgggttccgttaccccgtttcccccggacggtacccctaaccccgtaccccgttaaccgaaacgtacccgtaccgtaacccggtcggtacggggaccctaaccgggacgccccgggccggtcgggtacccgtcggtaacccgtacggaccggtaagtacccgtacggtccgtaacgtcggtacgtccggtcgtacgggacgtaccggggtcgtcggaacggtacggggaccgttaccgaacgaagcgtaagcccgngcggaac

SEQ ID NO: 147264 - DNA, 634 bp, Homo sapiens
  misc_feature: GYAE6OF01EBTC3.3.23.C01.1.454.CMB.1.raw
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (630)..(631): a, c, t, g, unknown or other
  misc_feature (630)..(631): n is a, c, g, or t
  modified_base (634)..(634): a, c, t, g, unknown or other
  misc_feature (634)..(634): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggaccacggccgcgaacacagtctatttggaactgaagaatttgaaaatctgacgacacggccgtgtattattgtgcgaggacaatctgtggccggtgacctgctacgtcgtagtttcgtcggggaccgtacggggaacccgttggtcccgaccggttccctccctcgacgtcccctaccaacccgaacgggtcccctacgttccggtccctttcccccgtcggcccctacccgttcccctaccgaacgacgcctacccgtcggtcggggaccacgacgccggcccgtgggccgtcgccgtggtaccgaacggtaccttaccgttaccggtagtcgtccgttccgtcgtcggacgggtcgggtccgttagggacggtacgggccgtaccgagttacggnacngnngtn

SEQ ID NO: 147265 - DNA, 559 bp, Homo sapiens
  misc_feature: GYAE6OF01DX070.3.23.C01.1.454.CMB.1.raw
  modified_base (522)..(522): a, c, t, g, unknown or other
  misc_feature (522)..(522): n is a, c, g, or t
  modified_base (553)..(556): a, c, t, g, unknown or other
  misc_feature (553)..(556): n is a, c, g, or t
  modified_base (558)..(559): a, c, t, g, unknown or other
  misc_feature (558)..(559): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccaggggaaccctggtcaccgtctcctcacgcctccaccaacgggcccatccggtccttcccctgccacccctccctacccaacgacgccacccgtcgtcggggccacgacggccggaccccgtgggcctcggcccgtggtaccgaacgggaccttacggttccgagtcgcgtctcgngacggcggcgtggcgaaggccgcgagtacgnnnngnn

SEQ ID NO: 147266 - DNA, 579 bp, Homo sapiens
  misc_feature: GYAE6OF01CXRGQ.3.23.C01.1.454.CMB.1.raw
  modified_base (574)..(575): a, c, t, g, unknown or other
  misc_feature (574)..(575): n is a, c, g, or t
  modified_base (577)..(579): a, c, t, g, unknown or other
  misc_feature (577)..(579): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtgggatggggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgtatttcgtggggccaagggaaccctggtccaccgtctcctcacgccctccaccgaacgggcccacgtccggtccgttcccccgtcggccctacccctccctaccaacgacgccacctcgtcgggggccaccgacgccggcccgtcgggccgtcggcccgtcggtaccgaacggtaccttaccgttccgtacggtcgccgtctcgtggcggccgggcgtggcgaagggccgcagtacganncnnn

SEQ ID NO: 147267 - DNA, 641 bp, Homo sapiens
  misc_feature: GYAE6OF01C0EHA.3.23.C01.1.454.CMB.1.raw
  modified_base (199)..(199): a, c, t, g, unknown or other
  misc_feature (199)..(199): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccngttccagggcagagtcaccatgtcgaagggacacggccgcgaacacagtctattggaactagaagtaatttagaaatcgtagaacgacgacggccgtgtattagtgtgcgagacatctggtcgcggtgactgctcgtcgtagttcgcggggacgacgggacctcggtcctaccgtctccgcgtacgccctaccgaaccgacgggccctacgttccggtcccttcccccgtcggtccctacccctccctaccgaacgacgtccgtccgtcggtcggggaccacgacggcccggtcccgtgggtcctccggccggttcggtaaccgtaacgggtaccttaccggttaccggtacggttcgtacccggttcctaccgtcgggacgggtcccgggcgggttacgggacccggtacggccgtaccgtaagtcggcgagtcgngngng

SEQ ID NO: 147268 - DNA, 655 bp, Homo sapiens
  misc_feature: GYAE6OF01BAE02.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgctccgaggggagagagcccaccctctcctgcgagggccagtccgagtgtcagcagccaaaccacttagcctaggtaccagcaagacgaccgtggaccaggcctcccgaggcctccgtcactccagtgggtcgaccactacccgaaaccgtacggggcccaacgtcgggacctacgtccccgaagacgtacggttcgaaggtcgggacgtaggtggggtactgggaaacaggtactttccgaaccttcaccgtaccaatccagacgacgacgtcggaactcgtacgaagtacgtttgacgttagtttatacgttcgtacctagacgtagttagttacggttaacttcgtacgttcgtttaggttaccgtaacggtttccgggcggtacgggtaaccgtagggtaggtacgtaacgttacgaaacggtacggtagtacggcgtacgaccgacctgttccgtgtttacccg

SEQ ID NO: 147269 - DNA, 857 bp, Homo sapiens
  misc_feature: GYAE6OF01B07OJ.3.23.C01.1.454.CMB.1.raw
  modified_base (200)..(200): a, c, t, g, unknown or other
  misc_feature (200)..(200): n is a, c, g, or t
tcagagacgcactccacgaccggtgctcgatttagtacacgtgattagggagttgggggagagctgctcagttaggacccagagggaaccacggaaaccccagcgcagcttctcttcctcctgctactctggctcccagataccccggagaaattcttttgacgcagtctccaggcaccctgtctttgtctccagggganagacgccaccctctcctgcacgggccagtccgagtgtcagcagcaaccacttagcctggtaccaggcagacgaccgtggccagggcctcccgaggtctcctcacttcccaagttcggtgaccactcccgaaacgtcggggaccctaacgttcggggacctaaccgttcccccgaaggtaccgtaacggggttttccaaacggggttcgggtaccgtaaggggttcgggggttaccgttacggggtaaaccgtaacgggtacccttttcccgaaccgtttcctaaccccaaaccctaagttcccgtaacggaccgtaacgggtaacccgtacggggtaacggtacccgttaaggtaaacgttaccgttttaggtaaccgtttaaggtttttaaactttaaccggttagtttaccgtaggtaccgttaaggtttaccgttaacggggtttacccttttaccggtaacccgtttcggttttacggttacccgttaaacggttttccgggggaccgggttaacccggggtaaccgggttaaggggttacgggtaaaccgtaacggttaacccggtaaaacgggttaaccggttcgggttacggtaccggtaccggtacccgttaaccgtacgtttccgtttcgggtttccctttaacccgg

SEQ ID NO: 147270 - DNA, 738 bp, Homo sapiens
  misc_feature: GYAE6OF01DZAVA.3.23.C01.1.454.CMB.1.raw
  modified_base (732)..(732): a, c, t, g, unknown or other
  misc_feature (732)..(732): n is a, c, g, or t
  modified_base (734)..(735): a, c, t, g, unknown or other
  misc_feature (734)..(735): n is a, c, g, or t
  modified_base (737)..(738): a, c, t, g, unknown or other
  misc_feature (737)..(738): n is a, c, g, or t
tcagagacgcactccacgaccggtgctcgatttagtacacgtgattagggattggggcctcagtgaaggtctcctgcaaggcgtctggatacgacgtcagcaggaggtatatacacgtgggtgcgacacggccctggacaaggccttgagtggagtagggaataatcaacctagtgagtggtgcacaagctacgacaaaccgtagttccagggcagagtcacatgtacgaaggacacggccgacgaacacgtagtacttagttaggaactagaagtaatttagaaattcgtagacgacgaccggtcgttagttagttatggtagcgacggactaagttcgtaggtcggtaccgggtagtaccgttacggtaccgtttaccggttacggttacgtttttccgggaccggggggtaacccgttaaacgggggtaaccccgttcgggggttaccctaacccgggttcccgttacccgttaccgacccgtaccctaccccgtaaccggaaccgggtcccctaacggtttcccggttccccgtttcccccgtaccgggtacccctaccccgttacccctacccgaacgaccgtcccgtacccggttccgggcggggaccaccggtaccggcccggtcccgtacgggcctcggtcccgttacggtaccgacgtccttaaccgtcggagtccgcgttctcgcggtacgcgggcgtaggaccgacggtcgagtacgactnanngnn

SEQ ID NO: 147271 - DNA, 884 bp, Homo sapiens
  misc_feature: GYAE6OF01CDBOC.3.23.C01.1.454.CMB.1.raw
  modified_base (326)..(326): a, c, t, g, unknown or other
  misc_feature (326)..(326): n is a, c, g, or t
tcagagacgcactccacgaccggtgctcgatttagtacacgtgattagggagttggggagagctgctcagttaggacccagagggaaccatggaaaccccagcgcagcttctcttcctcctgctactctggctcccagactacccccggagtaaattcttttgacgcagtctccgaggccaccctgtctttgtcctccgaggggagagacgcccacccttctcctgcgacgggccaggtccgagtgtcagcagcaaccacttagcctggtaccagcagacgaccgtggaccacggcctaccgaggtcctcctcactccagtcggtncctaactacccgaacggacgggtccctaacggtcggacctacgtacccgaaggtaccgtacggtttacgaaggttcgggaccgtaaggggttcgggtacgtacgggtaaaactacggttaacccgttccgaaccgtttccgtacccgtaaaccctacggttacccgaacggtaaccgtaaccggtaacggttaacggggaaccgttacccgttaacgggtaaaccggtttaccgttttacggtaacgtttaacgtttttaaccgttaccggtttacggttaccgtttaacggtacgtttaaacgggttttacgtttaccgggtttaacctttaccgttaacccggttttaccggttttaccggttaacccgttttaaccgggtttacccggggtacccggggttaaaccgggtaaaccggttaaacggggtacgggttaaccgtaaaccggttaaacccgggttaaaaacggttaccgggtttacgggttaacggggttaaccctaccggggaaccctttaaaccggttccgtttaccggtttacgttttaacccccg

SEQ ID NO: 147272 - DNA, 611 bp, Homo sapiens
  misc_feature: GYAE6OF01EQRCM.3.23.C01.1.454.CMB.1.raw
  modified_base (555)..(555): a, c, t, g, unknown or other
  misc_feature (555)..(555): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagataccccggagaaattcttttgacgcagtctccaggcaccctgtcttgtctccaggggagagagccaccctctcctgcgaggccagtccgagtgtcagcagccaaccacttagcctggtaccagcagacgaccgtggaccaggcctcccgaggcctccctacatcccagtggtcgacaccgtaacccaagggaccggacctacggtcggactacccgtaccgacgacggtacggtacgtaaggtcggagtagggtcggtcgtaacggaacgtacgttaacttccacttcctacaccgtataccaggcaacgtcggtacggactcgtaagaacttcgttacgactttaagtttacttgcgttagtgacgttagtagttcgttactcgtactttgtgtacttaggtcggacggcgaacgngggtagattacgaacgtaacggtcgttggacgtcgacgaccctatcttgtcgttac

SEQ ID NO: 147273 - DNA, 778 bp, Homo sapiens
  misc_feature: GYAE6OF01B62XQ.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagacgccaccctctccgtgcgagggccaggtccgagtgtcagcagccaacctacttagcctaggtaccagcagacgaccgtggccaggcctcccgaggcctcctacactccgaagtgggtcacgactacccgaacgacgggaccaacgtcggacactcccgaagacgtaggttacaggtcggactagggtcggtacgtacgggaaactacgtaccttcgaaccgttcctaccgaaccctagttaccgaacgtaccgaacggtaacgttacgggaccgtaccgtaaggtaaacgttacgttttacggactttaaacggttttaactacggttacgttaccgtacggtacgttaaggtttacgtttaccggtttaacctttacgtaaccgttttcggtttaacgggttaacgtttaacgggtttcccggggtaaccggggtacccgggttaaaccggtaagggggttaacgggtaacggttaaccgttaaaccggtaaaaccgggttaacggttcgggttaccgggtaccgttaccggacccgttaaacccgtcggttttacccgttaggtttaccccg

SEQ ID NO: 147274 - DNA, 770 bp, Homo sapiens
  misc_feature: GYAE6OF01EMFVM.3.23.C01.1.454.CMB.1.raw
  modified_base (245)..(245): a, c, t, g, unknown or other
  misc_feature (245)..(245): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatggaataatcaacctagtgatggtggcacaagctacgacaacctagtaccagggcagacgtcacatgtcaagggacacggaccgacgaacanacgttctaagtttggaactaggaaagtaatttagaaaatcgtagaacgacgaaccggtccgttagttaacttagtttggtgacggaacggtacctaatcgtggtcgtcgggtgtactgtctacggtcgttagttcgacggggaccgtacggggtaccgtcggtaccgaccgttccgtcctacgaccgtacccacccaaccggaaccggtacccctaacgttcccggttaccctttcccccgtaccggtcccctaccccctccctaaccgaacgtacccgacctaccggtccgggacgggtacccacggtaccgggccccgggtcccggttcgggccgtttcggtcccggttacggggtacccgtaaaaccgggttacctttaaccccgggttaccggttaacgggttcccgggttaccccgtttccggtaccggttaaccggggcccggggttacgggggtacgggtacccgggttaaaggggacccgggtcgacccgttaaagggtccgagtacggngngngcg

SEQ ID NO: 147275 - DNA, 709 bp, Homo sapiens
  misc_feature: GYAE6OF01AXCR2.3.23.C01.1.454.CMB.1.raw
  modified_base (695)..(695): a, c, t, g, unknown or other
  misc_feature (695)..(695): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaattcttttgacgcagtctccagcaccctgtctttgtctccgaggggagagcgccaccctcctccgtcgccgacgggccacgtccgagtcgtcagcgacgaccaaccacgttacgccgtaggtaccagacgaagaacgaccgtcggacccacggccctcccgacggctaccctcactccagtcggtgaccactaccgaacgacggccacgtgcctacgacccagtacgtaggttaccaggtcgacgtaggtcgggtacgtacggaaacctaggtaccttacgtacctctaccgaacctacgtactacgacgtacggccgtacggacgtaccgtaagtaaacgtcgtttacgtacgtttaacgttttacgttacgttcgtacgttagtccgtaacggtttacgttacgttaacctttaccgttacgtttcgtaacggtttactttacgggttaccgggtaccgggaaccgggttacggtaacgggtaggtaaccgttaacgtaaccggtaaacgtaccgttggtaacgtcgtacgtaccgtacctnttcgtcgttaaccg

SEQ ID NO: 147276 - DNA, 671 bp, Homo sapiens
  misc_feature: GYAE6OF01A0LLE.3.23.C01.1.454.CMB.1.raw
  modified_base (606)..(606): a, c, t, g, unknown or other
  misc_feature (606)..(606): n is a, c, g, or t
  modified_base (661)..(661): a, c, t, g, unknown or other
  misc_feature (661)..(661): n is a, c, g, or t
  modified_base (667)..(667): a, c, t, g, unknown or other
  misc_feature (667)..(667): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcgaagggacacggccgccgaacacagtctattaggaactgaagaatttgaaatctgacgacacggctgtattatgtgcgagacaatctgtgcggtgactgctcgtcgtatttcgtcggggcctaacgggaccctcgggtccgtaacccgtcctcccgtcgacgtcccctacccgtaacccgaaccgggtcccctacgtacccggttccccttccccccggtcggaccctacccccctcccgtacccctaacgacgacccgtaaccccgtccgggtcgggggtcccaacgtccgggacccgggtccccgtacggggtcccgtcgtcccggtacgggtaaccgtaccgggtacccttaacggttcccgtaggttccgccgttaccncgttacggacggccggggtcctgggtaccgaagggtccgaccgtaagtcggtacngcctgngtcg

SEQ ID NO: 147277 - DNA, 741 bp, Homo sapiens
  misc_feature: GYAE6OF01BZDQB.3.23.C01.1.454.CMB.1.raw
  modified_base (726)..(726): a, c, t, g, unknown or other
  misc_feature (726)..(726): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcacctgtctttgtctccgaggggagagagccaccctctcctgcgagggccagtccgagtgtcagcacgacaaccacttacgcctggtaccagcagacgaccgtcggccgaggcctccgaggcctccgtcactccagtcggtcgactactaccgaacgacgggcccacgtcggacctactacccgaaggtaccgtacgggttccaggtacggacgtaggttcggggtacttaacgggaaactaacggtaccttacaccgtttcctaccaaccctatacgacgacgtaacggtacgtagggtacgcccgttaaggtaaacggttcttttacggaccgtttaagtttttaacttaccgttggtaccgttacggtactaagtttagttccggtttaacctttaccggtaccttttaccggtttagggttaccgtttaacggtttacccgggggaccggggttaaccgggtaaaccggtaaggggtcgggtaaaacggtacttaacccggaaacgggttaacttgggtacggtacctacgggacccttaacccggtnttccgttcggttacc

SEQ ID NO: 147278 - DNA, 799 bp, Homo sapiens
  misc_feature: GYAE6OF01C44SZ.3.23.C01.1.454.CMB.1.raw
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
tcagagacgcactccacgaccggtgctcgatttagtacacgtgattagggattggggagagctgctcagttaggaccagagggaaccatggaaaccccagcgcagcttctcttcctcctgctactctggctccagactacccccggagaaatttctttgacgcagtctcaggcaccctgtctttgctccgagggganagtacgccaccctctcctgccacgggccagtccgagtcgtcagcagccaacctcgttagcctaggtaccagaccagacgaccgtcgggaccaggtctcccgaaggtcctaccncaactccgtagtcggttcgacctaacgtcccgaaacgcgggaccacgtacggacctaacgtccccgaaaggtaccgtaagggtttccaagggtttcggaccgtaacggggttcggggttactaaacggggaaacctacggttaaccgtttacctaacctcccttaacggtaaaccaaccgttaccgtaacgaaccgtaaccggtacgttacgggaacgttacccgtaacgtaaacggtttaccgtttacgtatttaacggttttacttacgtcgttactacgggtacttaaggtttacgttacgtttacccgttacccgttagttttaccggttagggttacccttttaacgggttttccgggacggggtaacccggggtttaaacggaggggttacggtaacggaaacgtttaaaccgaaaccgggtaaacggtttgtacccgggtatcccgggtaaactacccggttacttaccgtttcgttacccg

SEQ ID NO: 147279 - DNA, 576 bp, Homo sapiens
  misc_feature: GYAE6OF01EF3NQ.3.23.C01.1.454.CMB.1.raw
  modified_base (340)..(340): a, c, t, g, unknown or other
  misc_feature (340)..(340): n is a, c, g, or t
  modified_base (570)..(571): a, c, t, g, unknown or other
  misc_feature (570)..(571): n is a, c, g, or t
  modified_base (574)..(576): a, c, t, g, unknown or other
  misc_feature (574)..(576): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgacgaacacagtctattggaactgaagaatttgaaatctgacgacacggccgtgtattattgtgcgaggacaatctgtgccggtgactgctacgtcgatttcgnggggccagggaaccctggtccaccgtctcctcacgccctaccaccgaacgggccccagtccggtccttcccccctggcccacccctccctccaacgacgccaccctcgtcggggccacgtacggcccggcccgtggggcctcgcccgttggtaccgaacggtaccttaccgttccgaggtccgtcgtcctcgtgacggcgggtcgtcgggacgtacggccgcctaagtgnncgnnn

SEQ ID NO: 147280 - DNA, 634 bp, Homo sapiens
  misc_feature: GYAE6OF01BWDGR.3.23.C01.1.454.CMB.1.raw
  modified_base (626)..(626): a, c, t, g, unknown or other
  misc_feature (626)..(626): n is a, c, g, or t
  modified_base (629)..(630): a, c, t, g, unknown or other
  misc_feature (629)..(630): n is a, c, g, or t
  modified_base (634)..(634): a, c, t, g, unknown or other
  misc_feature (634)..(634): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgacgaacacagtctatttggaactgaagaatttgaaatctgacgacacggccgtgtattatgtgcgaggacaatctgtgccggtgactgctacgtcgtatttcgcggggccacgggaccctggtccaccgtctcctcacgccctacccacgaacggcccctagtcccggttcccttcccccgtccggcccctaccccgtaccctacccgaacgaccgtaccgtacccgtccggtcgggggaccctacgacccggccgggtccccggtcgggtccgtcggtcccgttcgggtaccgtaacgggtaccttaccgttcccgaggtccggccgttccgttccgtggacgggtccgggtccgtagggaccggaacgggccgtacgtaagtcggtnagnncgtn

SEQ ID NO: 147281 - DNA, 659 bp, Homo sapiens
  misc_feature: GYAE6OF01DYBV8.3.23.C01.1.454.CMB.1.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (369)..(369): a, c, t, g, unknown or other
  misc_feature (369)..(369): n is a, c, g, or t
  modified_base (653)..(653): a, c, t, g, unknown or other
  misc_feature (653)..(653): n is a, c, g, or t
  modified_base (655)..(657): a, c, t, g, unknown or other
  misc_feature (655)..(657): n is a, c, g, or t
  modified_base (659)..(659): a, c, t, g, unknown or other
  misc_feature (659)..(659): n is a, c, g, or t
tcagagacgcactccacgaccggtgctcgatttagtacacgtgattagggagttggggcctcagtgaaggtctcctgcaaggcgtctggatacgacgtcagcaggaggtatatacacgtgggtgcgacaggccctggacaaggccttgagtggatagggaataatacaaaccctagtagagtggtggcacaagctaacgacaaaccagttccgagggcagagtcaccatgacaagggacacggccgacgaactacgagtctagttaggaacttagaagtaatttagaaatctagacganacggctagtattattgngcgaggactaagtctagtggccgtagtactcggacttacgtcgtagtttcggngggaccgacggaaccctggtacacctcgtactccgagtcccaccgaacgtaacggccctacgttccggtcccttaccccgtcgaccccgtacccttacccaccgaaacgtacgaccgtaacccgtcgggtacggggaccaccggaaccggtccgggtacccggtacgggttaccgcgtaccggtacgtaccggaacggtaccttaccggttacccgtagtcggtaccgtcgtcgtacgggtacggaccgggtcgaggacggaacggtcgaaccgtaagcggacngnnngn

SEQ ID NO: 147282 - DNA, 818 bp, Homo sapiens
  misc_feature: GYAE6OF01DDQ1O.3.23.C01.1.454.CMB.1.raw
  modified_base (202)..(202): a, c, t, g, unknown or other
  misc_feature (202)..(202): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccagactacccccggagtaaatttcttttgacgcagtctccaggcaccctgtctttgtctccgagggganagacgcccaccctctcctgcgagggccagtccgagtgtcagcagaccaaccacttagcctggtaccagcagacgacctggccaggcctccgaggcctaccgtcacttccagttcggtcgacactacccgaaacgacggggtacccacgtcggaccaacgtccccgaaggtaccgtaggttaccgaggttcggaccgtaaggggtcgggttacgtaacggaaacctaggttaacccctttcgtaaaccttccgttaaccaacccgtacgttacgaacggtaccgtaacggtaacgtacgggaacgtacccgttaacggtaaacggtttacgtttaccggtacgttttaagtttttaacgttacccgttaggtttaccgttaggtaaccgttaaggtttaacggtttacgtttaacccgttttaccgttaccgtttacggttttacggtttaacgtttaaccggggtttcccggggaaccggggttaacccggggtaaccggtaaagggggttacgtaaacgggtaaacgttaaaccgggtaaaacggttaccggttacgggttacggtacgttaccgtaacccggtaacccttaacgttacccgttcggtttaaccc

SEQ ID NO: 147283 - DNA, 757 bp, Homo sapiens
  misc_feature: GYAE6OF01DMYKF.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctccagatacccccggagaaattcttttgacgcagtctccaggcacctgtctttgtctcgaggggagagagccaccctctcctgcagggccagtccgagtgtcagcagccaaccacttagcctaggtaccagacagacgaccgtggaccacgggcctcccgaagggtccttccctccaacgttcccgaagttgggtacgacctaacgtaccccgaaacgacggggacccacgtcgggaccactaccccgaagtaccgtaaggtttccgaggttacggcgtaacgggtcggggttcgtaggggactaggtacgtttccaccgttcttaccgaacctacgttccgaacggtacctacggtccgttacggaccgttacggttacgttacggtaaaaggtttctttttaccggttactttaacgttttttacgtttcgttacgttacgtaagttaccgttaagttaaactttaaacggttaaccgttcgggttaccgttccggggttacggtaccggggtttaccggggacccggggtaaaccggtaacgggtaggtaaggtacgtaaacggtaaacggtaacggtggttacggacgttacgactaaccgtagttaccgttgttcgttacg

SEQ ID NO: 147284 - DNA, 862 bp, Homo sapiens
  misc_feature: GYAE6OF01A09FH.3.23.C01.1.454.CMB.1.raw
  modified_base (203)..(203): a, c, t, g, unknown or other
  misc_feature (203)..(203): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaatttcttttgacgcagtctccaggcaccctgttctttgcctccgagggganagacgcccaccctctccgtgccgacgggtccaggtccgagtcgtcgaggccacgtaccaaacctacgttacgcctacggtaccaggacaagacgtaccgtcggaccgacggtccctaccggaggtcccttccctacgacttcccgaaggtcggtacgacctaccgtaccgaaaccggacggtaccacgcgaacccaacgtaccccgaaggtaacgtacgttacgaacggtcggaacccgttaggggtaccgggtacgtacggtaaaacctaccggttaaaccttcccgtaaaccttccgtaacccgaaaccttaccgtaacgacgtaacggaaccggtaccggtacgggacccgttaacgtacggaaacgttaccgtttaccgtaacgtttacgttttaacgtacgtttacgtacgttacggtacttaacggtttcgttaacggtttacctttaccgtacccgggttttacggttacgtttaaccgttaacccgggttccgggaacccggggttaacgggttaacccggtaaggggttaaccggttaaccgtaaacggttaaacccggaaaccgggttacgggtttaccgggtaggtaacccccgttacgtaacccggttaaccctttacgggttaaaccgttccccggtttaacccgg

SEQ ID NO: 147285 - DNA, 723 bp, Homo sapiens
  misc_feature: GYAE6OF01C9Y1I.3.23.C01.1.454.CMB.1.raw
tcagagacgcactccacgaccggtgctcgatttagtacacgtgattagggattggggagagctgctcagttaggaccagagggaaccacggaaacccagcgcagcttctcttcctcctgctactctggctccagactaccccggagtaaattcttttgacgcagtctccgagcaccttgttctttgtctcgaggggagaggacgcctaccctctcctggacgacgggccacgtccgagttgacagacacgacaaaccactttacgccgtaggtacccagcgaaacgacggaccgtcgggaccgacggtaccctacccgaggtccctcctacactccgagtcgggtcacctacgtaccgaacggaccggacccgtacgttacgggacctaaccggacccgaaaggtaaccgtacggttacgaacggtcgggtaccgttaggggtcgggtacgtacggtaaactacggtaacctttccgacctttacaccgtactaacgcacgacgtagacgtaggacgtacgtacgttaacgttacgttacgtacgtttacgtttacgtttacgtcgtcgttaacgtacgtttatacggttacgttaacttcgttactttcgtacgtacgttaacggttccgggacggtacggtaaccgtaagggacgacgtaacgtaacgtaaacggtagtacggtacgtctacgacgtaactcttacgtcgttcgttacccg

SEQ ID NO: 147286 - DNA, 757 bp, Homo sapiens
  misc_feature: GYAE6OF01DE5ZH.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctcccagactacccccggagaaatttcttttgacgcagtctcaggcaccctgtctttgctcgaggggagagacgccacctctccgtgcgagggccagtccgagtgtcagcagcaaccacttacgcctaggtaccagcgagaacgaccgtaggacccaaggcctacccgaggtcctccgtacacgtccgagttcggacgacaacgtacccgaaacgacgggccacgtcggaccaacgtccccaaaggtacgtaggttaccgaggttggacgtaggttcggggtacgttaacggaaactacggtaccttacgtaactccgttaaccaacctaacgttaccaacggacccgtaaggtaaccgtgggaaaccgtccgtaagggtaaacttaacgtttgaaccgtttaggtttttaacttacgtacgttaccgtagtaaccgttagtttacgttaacggtttaccttacgtaaccgtttggttacggttaaccttaagggtttccgggggaacggttaacccgggggtaaagaccggggttaggtacgaaaccggttaagaaaaccgggttaacttcggggttacggacgttacggtaaacctaccgtaaagtttcgttaccgttaacccg

SEQ ID NO: 147287 - DNA, 633 bp, Homo sapiens
  misc_feature: GYAE6OF01E181J.3.23.C01.1.454.CMB.1.raw
  modified_base (154)..(154): a, c, t, g, unknown or other
  misc_feature (154)..(154): n is a, c, g, or t
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatatcactggagaaacngtgctgacgcagtctccagcccaccctgtctgtgtctccgaaggggaaancgcccaccctctcctgcagggccagtcagagtgttagtgctaacttagcctggtaccagcatattctggccaggctcccaggctcctcattcatggtncactcccgacccggccactggtactcccagccgtaggttccaggtcggcgaggttcgggtctcggacagtacgttccactctaccacactcagccaggtccctagggacttcgtagaacgtacttcgtgtaccgttagtttttaacttaccttggttaccaggtactaacggtttaaattaacgttaccgtcgggtaccggttacgggtaccggtttaccgggacccgtaaaggggtacccgtaaaagggttacggaaaacgtcccgaaaaacggtacgttcgggtacggccgttacacccgtactaaccgttcttacgttcctttacccg

SEQ ID NO: 147288 - DNA, 777 bp, Homo sapiens
  misc_feature: GYAE6OF01ALFIU.3.23.C01.1.454.CMB.1.raw
  modified_base (770)..(770): a, c, t, g, unknown or other
  misc_feature (770)..(770): n is a, c, g, or t
  modified_base (773)..(773): a, c, t, g, unknown or other
  misc_feature (773)..(773): n is a, c, g, or t
  modified_base (777)..(777): a, c, t, g, unknown or other
  misc_feature (777)..(777): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggcccctggacaaggccttgagtggatgggaataatcaaccctagtgatggtggcacaagctacgacaaaccagtccgaggcagacgtcacagtgtacgaagggacacggccgacgaactacagtacttagtttaggaactagtaaagtaatttagaaacttcgtagaccgacgacggtccgtagtactttagtgtaggcgaacgactaacgttcgtaggtcgccggtagtaccgtgccttacggtcgtacgttttccggtacggggacccgaaccggggtaaccccgtcggtacccgtacccggtttcctaccccgttcaccggtacccctacccgaacccggaaccgggcccctacgtttcccggttaccccgtttcccccgtacgggtccccctaccccgttacccctacccggaaacgtacccgtaaccctacccggttaccggggttaccgggggaccctaaccggaccgggtacccccgggtcccggtacgggggtccctccggtcccggttacggtacccggtaaccggtaccgttacccgttccggtacgttaccggtccgttccgtaccggtcgggaacggtccggggtccgttacggggacgaaccgggtcccgaaggttaagtcggtacgngcngcgn

SEQ ID NO: 147289 - DNA, 590 bp, Homo sapiens
  misc_feature: GYAE6OF01AQRJ3.3.23.C01.1.454.CMB.1.raw
  modified_base (200)..(200): a, c, t, g, unknown or other
  misc_feature (200)..(200): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaaccctagtgatggtggcacaagctacgcaaaccngttccagggcagagtcaccatgtccaagggacacggccgcgaacacagtctattggaactgaagaatttgaaatctgacacacggccgtagtattattgtgcgaggacaagtctgttgccggtgactcgactacgtcgatttcgcggggcacggacctggtcaccgtcgtcctcacgccctcaaccgacgggtcccacgtccgttccgttcccccgtcggccctaaccccgtccctacccgaaacgacgtccaacccgtcgtacgggggccacgacggccggtcccgtcggccgtcgccgtcggtcgaacggtacctccgtttacgacggtcgtcgtctccgtggtaggccgggtcgtggacggaaggtccgagacgtacgnancgnngn

SEQ ID NO: 147290 - DNA, 563 bp, Homo sapiens
  misc_feature: GYAE6OF01DTV5Z.3.23.C01.1.454.CMB.1.raw
  modified_base (338)..(338): a, c, t, g, unknown or other
  misc_feature (338)..(338): n is a, c, g, or t
  modified_base (558)..(559): a, c, t, g, unknown or other
  misc_feature (558)..(559): n is a, c, g, or t
  modified_base (562)..(563): a, c, t, g, unknown or other
  misc_feature (562)..(563): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggactaatctgtgcgtgactgctacgtgatttcgngggccagggaaccctggtcaccgtctcctcacgcctccaccgaacgggcccagtccgtccttcccccgtgccctacccctcctacccaagacgccacccgtcgtcggggcctacgacgccgggtccctgggcctcgcccgtcgggtaccaaacggtccttaacgttccgtagtcgcgttccgtctgcggtcggcgttggacgtacggcgagacgtacgcnncgnn

SEQ ID NO: 147291 - DNA, 846 bp, Homo sapiens
  misc_feature: GYAE6OF01BBSIJ.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggcctccagactacccccggagtaatttcttttgacgcagtctccaggccaccctgttctttgtcctccgaggggagacgacgcctaccctctccgtcggcgaccggggccacggttccggaggttgtacacgaccgacgaccaaacctacgttacgacccgttacggtaaccgacggtacgaacggaacggtaccgtcgggaccgacggccctacccggtacggtaccctcccgttacgaccgttacctacggttcgggtcaccgaccgtaacccgaaacggcggacccgtacgtcgacctaccgacccgaaggtacgtacggttacgaaggtcggtacggtacggtacgggtacctaagggaacctacggttacccttaccgtaccttaccgtaccctaaccggtactaccggacgtaccgaagggtaccgttaggaacgtaccggttaagttaacgtttaccgtttacgttacgtttagtttaacgttacgttcgttacgttacgtaacgttacggttacgtttaacgttaaccgttttcgtaaccgttttggttaaccggtttacgtacgggttacccgggtacgggtaaccggggtaaccggttaaagggtttaacgggaccgtttaaaacgggtaacggtaaaccggttaacggtccgggttaaccggtacgtaccgtaaccctacggtttacggttctacgggtttacccc

SEQ ID NO: 147292 - DNA, 667 bp, Homo sapiens
  misc_feature: GYAE6OF01CL3YW.3.23.C01.1.454.CMB.1.raw
  modified_base (337)..(337): a, c, t, g, unknown or other
  misc_feature (337)..(337): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaatatcaaccctagtgatggtgcacaagctacgcaaaccagttccgaggcagagtcacatgtcaagggcacggccgacgaacacgagtctagtttggaactgaaagtaatttagaaaattcgtagaacgtacgacggccgtagtattagttgtagcgaggactaatcgtggtcgccggtnacgtcgacgtacgtcgtacgtttcgtcggggacctacggggaacccgtggtacccgtaccgttcctccctcgacgtccctacccgaaccgaaccgggtaccccagttcccggtccccttcccccgtcggtacccctaccccgttccctacccgaacggtacctaccgtacccgtcgggtaccggggacctaccgacggtcccgggacccgtcgggcctaggcccgtagggtacaacggtcctacgttccgacggtcgtcgttctcgtacggacgggtccggtcgtacgggaccgtaacggggcccgagtacgtaacgngtagcgngngng

SEQ ID NO: 147293 - DNA, 662 bp, Homo sapiens
  misc_feature: GYAE6OF01DSLOL.3.23.C01.1.454.CMB.1.raw
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtgcacaagctacgacaaaccagttccagggcagacgtcaccatgtcgaaagggcacggccgacgaacacagtctagttgaactagaagtaatttgaaactctagacgacacggaccgtgtattagttgtagcgagacatcgtgcggtcggtgactgacgtacgtgtacgtttcggcggggaccgaacgggacccgttggtacccgtacccggttcctctaccgacgtccccacccgaaccggaaccgggccctaacgttcccgttcccttcccccgtcggacccctaccccgttaccctaccgacgtacgtcctaacccgttcgggtcgggaccaccgaccggtcccgggtcccgtcgggtcctacggtccgtacggtaaccgaacggtaccttaccggtcgtacggtccgtcgttccgtacgagggtaccggcgggtaccggtaggaccggaacgggtccaacgtaagtcgtacagacngngn

SEQ ID NO: 147294 - DNA, 696 bp, Homo sapiens
  misc_feature: GYAE6OF01DOW7F.3.23.C01.1.454.CMB.1.raw
  modified_base (217)..(217): a, c, t, g, unknown or other
  misc_feature (217)..(217): n is a, c, g, or t
  modified_base (340)..(340): a, c, t, g, unknown or other
  misc_feature (340)..(340): n is a, c, g, or t
tcagagacgcactccacgaccggtgctcgatttagtacacgtgattagggattggggagagctgctcagttaggacccaagagggaaccatggaaaccccagcgcagcttctcttcctcctgctactctggactccagactaccccggagtaaatttctttgacgcagtctcaggcacctgttctttgtctcgagggagagacgcccacctctccgngcgacgggccagtccgagtcgtacagcagtaccaaacctacttaacgccgtacggaccagacgagaacggaccgtaggcccaagggtcctaccgaggacctccgtacaacttccgagtcggtnaccgtactaccgaacgacggtccacgtcggacacgtacccgaagacgtacggttaccgaggtaggacggtaaggttcgggtacgtaacgggtaaaactccggttaaaccgttccgaacctttccgaacctaacccgaattccgaacggacgtacgtaacgggtaggaaccgtacccgttaggaaacgtttacgtttacggtaacgtttaagtttaaacgttcgttgtaccgtgtaactaggttacgtaacgttaccgtacttaccttgttacgtacgtaagttccgggacggacgtacgtaaggtgtagaacgtaacgacgtacgacggtgactcggaactgtactgttgtaaccc

SEQ ID NO: 147295 - DNA, 792 bp, Homo sapiens
  misc_feature: GYAE6OF01A6U63.3.23.C01.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagagacgcactccacgaccggtgctcgatttagtacacgtgattagggattggggagagctgctcagttaggacccagagggaaccatggaaacccagcgcagcttctcttccttcctgctactctggctcccagactacccccggagtaaactttcttttgaccgcagtctccgaggccacccttgttctttcgccttccgaggggagacgacgccctaccctctccgttcgccgacggtccacgtccgacgttgccgagcgaggccctaacctacttacgcccttacgggaacccagacacggttaacggacccttacgggaccgaacgggttcccacccggtaggtccccttaacccttacaccgttccgaacggttcgggttccaacctacgtaccccgaaagaccgggtccttacggacggtactaccncccggtanaacggtacggttcgaggtcgcgtacgggtcggaagttacgggaactagtaacccgtttcaaacctccgtacaaaccggtctaacgacgacgtacggtacgtacggacgtacgtaacggtaacttacttacggtaacttacggtttaaccttacgttcccgttagttaccgtacgttaagttaacccgttgttaaaccgttccgttaaccggtttacgtttaacggttaccgttaacggtttccggaaccggggttacgtaacgggtaaccgggtaggtacggtaaacgtttacggaacggttaaacgtcgtacggtaccgtacgaccgttacacgttctacgtttacg

SEQ ID NO: 147296 - DNA, 625 bp, Homo sapiens
  misc_feature: GYAE6OF01EWP37.3.23.C01.1.454.CMB.1.raw
  modified_base (204)..(204): a, c, t, g, unknown or other
  misc_feature (204)..(204): n is a, c, g, or t
  modified_base (323)..(323): a, c, t, g, unknown or other
  misc_feature (323)..(323): n is a, c, g, or t
  modified_base (613)..(613): a, c, t, g, unknown or other
  misc_feature (613)..(613): n is a, c, g, or t
tcagagacgcactccacgaccggtgctcgatttagtacacgtgattagggattggggcctcagtgaaggtctcctgcaaggcgtctggatacgacggtcagcaggaggtatatacactgggtgcgacaggcccctggacaaggccttgagtcgggatgggaataacgtcaaccctagtgatgggtgcacaagctacgcaaaccngttccgagggccagagtcaccatcgtcaaggtaccacggccgtacgaactacgagtcttagttcggaactgaagtaacgtttgaaactctaggacgaccgacggtccgtgtattagtgngcggaggtacaatcgtagtgaccggtgactgactacgtcgactttcggcgggaccgagggaacctggtcgaccgtcacctcacgtcctcccgaacagggccctaagttccgggttcctaccccgtggacccgtcccctacccgtacctaacgacgcctaccgtcggtcggggccaaccgtcgaccggcccgttcggccgtacgcccgtacggaccgtaagggtaccttacgtcacggtcgtaccttctacggtgtacggcggtctagggacctacggccgactacggtanctaagctgatcg

SEQ ID NO: 147297 - DNA, 813 bp, Homo sapiens
  misc_feature: GYAE6OF01EGL2O.3.23.C01.1.454.CMB.1.raw
  modified_base (571)..(571): a, c, t, g, unknown or other
  misc_feature (571)..(571): n is a, c, g, or t
tcagagacgcactccacgaccggtgctcgatttagtacacgtgattagggattggggagagctgctcagttaggaccagagggaaccatcggaaacccagcgcagcttctcttcctcctgctactctggctccagactaccccggagtaaactttcgttttcgacgcacgttcctaccgaggccacctgttctttcgtccgtccgagggagacggacgccctaccttccgtccgtcgcgacgggtccacggtccggacgttcgtacgacggaccgacggacctaaccgtaacgttaccggtaccgttacggtaaccgacggacgaacggacgtacccggtacggaccgtaacggtccgtacccgacggtcctccgtactaccgtaccgtcggtcggtaccgacgtaccgtaaccgacggtaccggccgtacgtcgtacctacgtaccgaaggtcgtacggtacgacggtcggacgtacgggttacggtacggtaacggaacgtaccgttctacctaccgtactaccgtaactaccgtagtaccgaagtaccgtacggtacgtaaccggttntaaaccggttaacggttcttacgggttactttaaggtttaccttaccgttcgtaccgttaggttacgttacgtttaacggttacccgttacgtttacccggttagtttccgtttaacggttaacgtttccgggtacgggtccgggtaaacggtacggttaacggacgttaacgtaaccggtaacggttaccggtgtcccggttagtaccgacctacgttaccgtcgttacgtcgttaacccg

SEQ ID NO: 147298 - DNA, 667 bp, Homo sapiens
  misc_feature: GYAE6OF01B9DX8.3.23.C01.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
  modified_base (643)..(643): a, c, t, g, unknown or other
  misc_feature (643)..(643): n is a, c, g, or t
tcagagacgcactccacgaccggtgctcgatttagtacacgtgattagggattggggagagctgctcagttaggacccagagggaaccatggaaacccagcgcagcttctcttcctcctgctactctggctccagactaccccggagaaattcttttgacgcagtctcaggcaccctgtcttgtctccgaggggagagacnccgaccctctccgtgcgacggccagtccgagtgtcagcacgcaacctattcgcctggtaaccgagcgtaagacgaccgtggccaggcctccgaggtcctccgacacgtacccattcgggacgactactacccgaacgcgggccacgtcgactactccgagacgtaggtccnggtcggcgtaggtggtactagggaacctggtactcacgtcctacacgtaactccgagaccgtacgtacgcgggtaaccgactacgtaaacgtctttagaacgtttaactttaattaccgtgtacctggtacgtaagtaactttcgggttacttacgtcctttagttacgttcgtaacggtttcgggaacggttacccgggacgtaacggggtacggttaacggaaaccgttacggaaaacggttcgtagggtaccgtagtaccggtaaccncgtttacgtaccgttcgttaaccc

SEQ ID NO: 147299 - DNA, 702 bp, Homo sapiens
  misc_feature: GYAE6OF01B0MBZ.3.23.C01.1.454.CMB.1.raw
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (655)..(655): a, c, t, g, unknown or other
  misc_feature (655)..(655): n is a, c, g, or t
  modified_base (697)..(697): a, c, t, g, unknown or other
  misc_feature (697)..(697): n is a, c, g, or t
  modified_base (701)..(701): a, c, t, g, unknown or other
  misc_feature (701)..(701): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggccctggacaaggcttgagtggatgggaataatcaaccctagtgatggtggacaacaagctaacgacaaaccacgttccagggcagagtacaccatgagaacggacacggccgacgaacacagtctattaggaacttgaaagtactttagaaatcgtgaacacgacggtctagtattatgtgngtagacatcgngtcgcgtnacgtgactacgtgtacttcggcgggaccacgggtaacccgtggtaccacccgtcttaccgacgtaccgtacccgtaccgaaaccggtacggggcccctaacggttcccggtaccccttccccggtacccgtacccgttaccccctaccttaacccgaaacggtaccgaaccggtacccggtacggttaccggggaccaaccgccggtccggtccccggttagggtcccgtcgtacccggtggtaacccgaccgggttaaccgttacccgttacggtaacgtcgttcccggttcgtaccggtcggtaaccgggtccggtaccggngggtaacccggtaacgggccgtaagaccgttaggaccgagangtgng

SEQ ID NO: 147300 - DNA, 766 bp, Homo sapiens
  misc_feature: GYAE6OF01BL9VF.3.23.C01.1.454.CMB.1.raw
  modified_base (165)..(165): a, c, t, g, unknown or other
  misc_feature (165)..(165): n is a, c, g, or t
  modified_base (744)..(744): a, c, t, g, unknown or other
  misc_feature (744)..(744): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagtaaattcttttgacncagtctccaggcaccctgtctttgctccgagggagagacgccaccctctcctgccgagggcccaggtcccgaggtcgtcaggcaacgccaaacctacttacgcctaggtaccagcagacgacctcggaccacggcctccgacggtcctaccactactcccgagttcggtcgactacgtaccgaacgtaccgggaccctacggtacgacctacctaccccgacggtaacgtaccggtttcgaacggtccggtacggtagggtccgggtacgtaacgggaactacggtaaccctttaccgaacccgttaccgtacccgaaacccgtacttaccgaacgtcccgaaccggtaccgttcgggtaacgttcgtaaagaaccgttcgtaaccgttgttaacccgtttaacggtttaccttactacggtaacgtacgtaacgtttaacttaataaccggtttacgaccggggtacccggttacggttaccggtacggaaccggtaacggaaccggttaaaggtaacggtaaaagtaaaccggtaaaccgtagggtaggtaccggagtaccgaccgtaccttacgtnttacgttacgtccttaacccgg

SEQ ID NO: 147301 - DNA, 888 bp, Homo sapiens
  misc_feature: GYAE6OF01CMO4K.3.23.C01.1.454.CMB.1.raw
  modified_base (626)..(626): a, c, t, g, unknown or other
  misc_feature (626)..(626): n is a, c, g, or t
tcagagacgcactccacgaccggtgctcgatttagtacacgtgattagggattggggagagctgctcagttaggacccagagggaaccatcggaaaccccagcgcagcttctcttcctcctgctactctggctcccagactacccccggagtaaactttcttttagacgctagtctccgaggcctaccttgttctttgtcctaccgaggggtagagacgcccaccctctcctcggcgacggccgtagtaccgagtcgtcgacgacacgaccaaacccgtacgttaccggccgtacggtaccgaaggccgtaaggaacgacccgtcggaccgtaacggtccctacccggacggtcccttcctactaccacgtacgtacggtcaaccgaaccgtacccgaaccgaccgggtaccacgtcgtaccaccgttacccgaacggtaacgtacgttacggacggttggacggtacggggtacggtacgaggtaaacctacgttacgttaccgtacctccgttaacaacccgtaattacccgaagaccggtaacgtaccgggtacggaagttacccgttaaaggtaaccggtttaacttacggttaacgtttaacggtttactttaaccgggtnttaccggttacggtaagttacgtaccggttttagttaccgttttaccgtacgttttaccggttttaacgggttttacggtaaccggggttttccccggggttaagggggaaccccggttacggggttaaaaacccggggttaggaaaaccggttttaaacggtaaacccgggttaaaacgggtacgggtttaaccggttacccgggaacgtttacccggaaactttacccctaagggtttacccgtttaacgttaaccccgg

SEQ ID NO: 147302 - DNA, 754 bp, Homo sapiens
  misc_feature: GYAE6OF01D6GYE.3.23.C01.1.454.CMB.1.raw
  modified_base (329)..(329): a, c, t, g, unknown or other
  misc_feature (329)..(329): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgacgaaccacagtctaattggaaactgaagaactttgaaatctagacgacacggccgtgtattacttgtgcgtaggacaatcgtgtgccggtnactgcgtacgtcgatttccgtggggccctaaggggaccctggtctaaccgtctcccgtaccacggaccctcccgaaccaacggggtccccaagttcccgggttaccttccccccgtacgggccctacccccgttaccctaccccaaacgaaccgaccgtaacccgttccggtaccggggggtaccctaacccgtaacggtccccggggtccccggtttacgggcccggttacggtaccccggttacggggttaccccgtaaaacgggggtacccgtttaacccggtttaacccccgggtaaggttccgggtacccggttacccgttaccggttaccggtaaccggggtccgggggtaccggttaccggggaccggtaaacgggccgggtaaccccgaaggtaaacgtccgagtccgagccgtaag

SEQ ID NO: 147303 - DNA, 933 bp, Homo sapiens
  misc_feature: GYAE6OF01A8P1U.3.23.C01.1.454.CMB.1.raw
  modified_base (380)..(380): a, c, t, g, unknown or other
  misc_feature (380)..(380): n is a, c, g, or t
  modified_base (915)..(915): a, c, t, g, unknown or other
  misc_feature (915)..(915): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacgacggccccgtggacaaggccttgacggtggagtgggaaataagtacaaccctagtggactgggtaggcaacgaagctacgacaaaccgacgttaccgagggcaagacgtacaaccagtcgtacgaaacgggacaaccgggacccgagaaaccacgagttaacttacgtttaacgggaactaggaaacgtaagttttaacgaaactcgtaaggtaaccgaacgtaacggtaccgttagttaattacgttacggnggtaacggaacggtaacgtaacgtacgtagggttaccggaccggttagaaccgttacgtaccgttaccggtacggttaacgtttcgggacgggggtaaaccgtaccggggtaaacccgttcgggtaacccctaaccgggttccttaaccccgtaccgtaaacccgtaccccgtaacccggaaccccggtaaaccggtcccccgtaacggtttccccggttaccccgtttaccccccgggtaccggtaaccccgttaccccccttcccgtaaacccggaaaaccgtacccgggtaaccctaacccggttacgggttaccggggaaccaaccgggtaccggtaccccgggtaccggttacggggtcccgttccgggacccgggttaacggttaacccggaaaccgggttaaccctttaaccgggtttccccggtaacgtggtaacccgggtcccgttacgggaccggttaaacggggtcccgggtaaacgggttcgggtaacccggggtaacggaccggtaaccgtacggtaaaccngtaccgatacggtatcgg

SEQ ID NO: 147304 - DNA, 696 bp, Homo sapiens
  misc_feature: GYAE6OF01EMATF.3.23.C01.1.454.CMB.1.raw
  modified_base (632)..(632): a, c, t, g, unknown or other
  misc_feature (632)..(632): n is a, c, g, or t
  modified_base (692)..(692): a, c, t, g, unknown or other
  misc_feature (692)..(692): n is a, c, g, or t
  modified_base (694)..(695): a, c, t, g, unknown or other
  misc_feature (694)..(695): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttggagtggatgggaaactaatcaaaccctagtgatggtggcacaagctaacgcaaaccagttccaagggcaagagtcaccaatgtacaaagggacacggccgacgaacacagtctatttaggaactgaaagtaaattcggaaaatcgtagaacgtaacaacggccgtagtacgttagtttgtaggacgaacggaactaaagtctggtacggtccggtagtaacctggtacttacggtacgtagttttcgcggggggacctaaccgggaacccctgggtaccctaccgtcctccgtacacgtcccgtaccgaaccgtaacgggccccaagttcccggttaccttccccccgtggtaccctaccccttcctaccgtaacgaacgaccgtacccgtccggtacggggaccaacgacggcccgggtaccgtcgggacctcggtcccgtacgggtacgaacggtaacctaaccgttacggaagtcggtccgtntacgttacggaacggtccgggtcgtggaaccgtaacggcgaacgtacgtacgagagtacngnng

SEQ ID NO: 147305 - DNA, 869 bp, Homo sapiens
  misc_feature: GYAE6OF01AHX1O.3.23.C01.1.454.CMB.1.raw
  modified_base (859)..(859): a, c, t, g, unknown or other
  misc_feature (859)..(859): n is a, c, g, or t
  modified_base (863)..(863): a, c, t, g, unknown or other
  misc_feature (863)..(863): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggccctaggacaaggtccttggagtggatgggaaataataccgaaccctagtgatggtgcacaagctacgcaaacgtacgttccgagggcagacgtcaacctagttcggacgaaaggggcccgaaccgggtccggaacccgaaacacctaggttacctttaaggttttaacggaacccgtagaaaacggttaattttaagaaacgttactacggaacgtaccgaaccgggttcgttagtttaagtttgttacggtaggccggtaacggactaaccgttcgttaggtccggacgggtttacgaacgttggtaccggttacgttacggtttacgtttaccggtcggggggaacccgtaaaccgggtaccgttcgggtaaccctaccgggtcccttaccgtccgtacgcccccgtaccgtaaccggacccggtaccctccgggtttaccccgtcccgtttaccccgccgggtacccccttaccccgtaccctaacccggtaaccgtaccgtaccccggttacccggtaccggggttccggggactaccccggggtcgtaccccgggccggttaccgggttccggtaaccgttccgggtaaccggtaccggtaaaccggttacccggtttacccgaccgggtacgtttacccggccgggttaccttcccggaacggggtcccggtacggggtcccggacgacgggaacccggtcggtaacgacggttcgatagtnccgnggtacg

SEQ ID NO: 147306 - DNA, 912 bp, Homo sapiens
  misc_feature: GYAE6OF01BSRIQ.3.23.C01.1.454.CMB.1.raw
  modified_base (906)..(906): a, c, t, g, unknown or other
  misc_feature (906)..(906): n is a, c, g, or t
tcagagacgcactccacgaccggtgctcgatttagtacacgtgattagggagttgggcctcagtgaaggtctcctgcaaggtcgtctggtatacgtacgtcagcaggaggtatatacactgggtgcgacaggtccctggacaaggccttgagtggtattgggaataacttactaaacccgtagtgagtggtggcgacaagctacgcaaaccgagttccgagggcagagtcaccgagtcggtaccaagggacacggccgacggtaaccacacggtactacgttttagggaacttggtaaacgtaacttttaggaaaacttcgttaggaaccgtaacgaccgggtaccgttaggttaaacgttttaacgtttcgggttacgggaccgggtaacggggtaccctaaaaggttcccgggttagggttacggggacccggggtttagtaccggttacgtaccgttttaccggtacgttaacgtttttccggacgggggggtaccctaacgggggtaacccctgggttaccctaaccgttccgttacccttaccggacgttacccgttaccccgaaccgtaaccgggggtacccctacggttcccgggtttccccgtttccccccgttaggcccctaacccccggtttccctacccggaaacggacctacccggtaacccttccggggtacggggtacccaaccggtaccgggaccccgggttccccgtacggggtacccttaccggtcccggtttacggtaccccggaaacgggttaccccgtttaacccggtacccggttaacggttccggtacccgtttacggttacggtacggtaaccgggtccggggtaaccgttggggaaccccgttaaaggggcccgtaacgtaacgttacgggactggacgtgnggtacc

SEQ ID NO: 147307 - DNA, 772 bp, Homo sapiens
  misc_feature: GYAE6OF01AIH6T.3.23.C01.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggcctcccagtactacccccggagaaatttctttgacgcgacgtctccgagccaccctgtctttgtctccgagggganagacgcccacccgtctccgtgccgacgggcctacgtcccgagttcgtcgaacgcgaggaaccaaaccctagttacgcccgttacggtaaccngaccaggacgccgtcggaccnggcctcccgaggtcctacgtcactcctaggtcgtnccactacgacgtacgggcctacgtcgactcgacccgtagaacgtacgttcgaaggtcggccgaggttcgggactagaccgtagtactcctactccgtcaactcgaccacggtcgtacgacgtaggcgtacgtaacgtagttaccgtttcgaaccgttttacgtttcggtttaccgtgttaccgtacggttacgttacgggtttacgttaccggtttaccgttccgtaacgtttaccggggtttacttacccgggtttaaaccggtttccggggggaacccgggttaccggggtaaacccggttaacggggtaccggtaaaaccgggttaccggttaaacggttaaacccggtacgggttaccgggtaccgttaccggactttaaccccgaccgtttacttccgggttaaccgttcccg

SEQ ID NO: 147308 - DNA, 883 bp, Homo sapiens
  misc_feature: GYAE6OF01B84X5.3.23.C01.1.454.CMB.1.raw
  modified_base (874)..(874): a, c, t, g, unknown or other
  misc_feature (874)..(874): n is a, c, g, or t
  modified_base (879)..(879): a, c, t, g, unknown or other
  misc_feature (879)..(879): n is a, c, g, or t
  modified_base (881)..(881): a, c, t, g, unknown or other
  misc_feature (881)..(881): n is a, c, g, or t
tcagagacgcactccacgaccggtgctcgatttagtacacgtgattagggattggggcctcagtgaaggtctcctgcaaggcgtctggatacgacgtcagcgaggaggtatatacacgtgggtgcgacacggcccgtggaacaaggtccgttaggaggtggagtagggaataataccaaccctagtagtagtggtggcacgaacgcgtaaaccgacaaaaccgtacgttaccggaacgggacgacggtacggtaccaccgtaagttacggtacgaaaggggaaccgaccgggaccgaaccggaaaacctacgacggtttaccgtaaggttttaacggaacgtaagtaaacgtaaagtttaacgaaagttacgtaacggaaccggtaaccggtaccggtacggttcgttaacgtttaagttcgggtacggacggtacgtaacgtaaacttcggtacggtcggtccggtagtaacgtcggtacgtaacggtcgttaggttccgggtccggggaaccgtaaccggggtacccgtacggtacccgttacccggtaccctccgttaccgcccggtaacccctacccggtaaccggtaaccggggtacccctacgggttccccgttcccgtacccccggtaccgtaccccgtacccgtaccccgtaacgaaccgtacggtaccccgtccgggtacgggtaccggggtaccaaccggtaccggtaccgggcccggttcgggtcccggttaccggtacccggtcggttaacccggaacgtttaacccggtaccggttacggtcggtaccgttacggtccgtccggtagggtacgggcccgggtcggtaccgggacgtacccgggacgtacgtaaggtacgcncgtangntg

SEQ ID NO: 147309 - DNA, 667 bp, Homo sapiens
  misc_feature: GYAE6OF01BXH3Z.3.23.C01.1.454.CMB.1.raw
  modified_base (241)..(241): a, c, t, g, unknown or other
  misc_feature (241)..(241): n is a, c, g, or t
  modified_base (596)..(596): a, c, t, g, unknown or other
  misc_feature (596)..(596): n is a, c, g, or t
  modified_base (618)..(618): a, c, t, g, unknown or other
  misc_feature (618)..(618): n is a, c, g, or t
  modified_base (647)..(647): a, c, t, g, unknown or other
  misc_feature (647)..(647): n is a, c, g, or t
  modified_base (653)..(653): a, c, t, g, unknown or other
  misc_feature (653)..(653): n is a, c, g, or t
  modified_base (659)..(660): a, c, t, g, unknown or other
  misc_feature (659)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (667)..(667): a, c, t, g, unknown or other
  misc_feature (667)..(667): n is a, c, g, or t
tcagagacgcactccacgaccggtgctcgatttagtacacgtgattagggattgggggcctcagtgaaggtctcctgcaaggcgtctgggatacgacgtcagcaggaggtatataccactgggtgcgacaggcccctggacaaggccttgagtggatgggaataactacaaccctagtgagtggtggcacaagctacgacaaaccagtccgagggcagatccacatcgtacgaagggaccncggccgacgaacacagtctattaggactaggaagtaagtttagaaatcgtagacgacgacggccgttgtattatggtgacggaggactaacgttcgtggtagccggtgactcgcttacgtcgtagtttcgccggggtacgacggggtaccgtacggtcgtaccgtctcctaccgacggtccctacccgaaccggtaaccgggccctacgttcccggttacccgttccccgtaccggcccgtacccctacccgttcccaaacggtaccgccgtaacccgcgggtacgggtacccgacgaccggcccgtccgggtcggtccgcggtccgtagggtccgacggtaccgttcgttcggngttacccggtcgtaccgtacgngaccgggtccgggagtcggaggacccggngtaacngtacgnnancngtn

SEQ ID NO: 147310 - DNA, 624 bp, Homo sapiens
  misc_feature: GYAE6OF01DN3SD.3.23.C01.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (430)..(430): a, c, t, g, unknown or other
  misc_feature (430)..(430): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (500)..(500): a, c, t, g, unknown or other
  misc_feature (500)..(500): n is a, c, g, or t
  modified_base (617)..(617): a, c, t, g, unknown or other
  misc_feature (617)..(617): n is a, c, g, or t
  modified_base (622)..(622): a, c, t, g, unknown or other
  misc_feature (622)..(622): n is a, c, g, or t
tcagagacgcactccacgaccggtgctcgatttagtacacgtgattagggattggggcctcagtgaaggtctcctgcaaggcgtctggatacgacgtcagcaggaggtatatacacctgggtgacgcaggcccctggacaaggccttgacgtggatagggaataagtcaacctagtgatggtgcacaagctacgcaaccngtacnggcagacgtcacatcgtcgaaacggcacggccgtcgaaccacgtagtctatttcggaaactgaagtaactttgaaacttcctagacgaacctacggtccgtagttacttagttggtagccgaaaggtactaagtcgttggtcggtaccggtagtaccgttcggtaccgtacgtccgtatttcggacggggtaccgaacgggtacccgttggtaccgccggttacncccgtacacgcctaccgaccgagtccctagtccgtctcccgtcgcctcctcctacaacgcnccncgtcgngggcctacgcgtaccggcgtagccgtcgtccgtacgtccgaagtccttacgtccgggtatcgtccgtacctagtcggcggaccggactgggactacgggacgtacaaggtcgcgtanactgngc

SEQ ID NO: 147311 - DNA, 694 bp, Homo sapiens
  misc_feature: GYAE6OF01A8LWJ.3.23.C01.1.454.CMB.1.raw
  modified_base (690)..(690): a, c, t, g, unknown or other
  misc_feature (690)..(690): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatggggaataatcaaccctagtgactggtggacacaagctacgacaaaccagttccagggcagagtcaccatcgtcgaagggacacggccgacgaacacagtctagttggaactgaaagtaatttagaaactctagaccgacgaccggtccgtgtaactttagtgtcggcggtaacggacaactcgtggtcggtcccggtgacttcggtacgttacgtcgttacgtttcggccggggtacccgacgggtaacccgtcggtaccgtacccgtctacccgtcgaccgccctacccgaaccggaaccgggtccccaggttcccggttccccttacccccgtggcccctaccccgtccctacccgtaacgccaccgtccgtcggtacggggaccacgccggcccgggtccgtcgggtccgtccggacccgttacgggtaccgtaacggtacccgtttaccgtaccgaggtccgtccggtcttcggtcgggtacggtccgggtcgtcgggaccgacgggccgacggtagtacgcgagtctcgngtac

SEQ ID NO: 147312 - DNA, 690 bp, Homo sapiens
  misc_feature: GYAE6OF01BDPZH.3.23.C01.1.454.CMB.1.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (398)..(398): a, c, t, g, unknown or other
  misc_feature (398)..(398): n is a, c, g, or t
  modified_base (678)..(678): a, c, t, g, unknown or other
  misc_feature (678)..(678): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (688)..(690): a, c, t, g, unknown or other
  misc_feature (688)..(690): n is a, c, g, or t
tcagagacgcactccacgaccggtgctcgatttagtacacgtgattagggattggggcctcagtgaaggtctcctgcaaggcgtctggatacgacgtcagcaggaggtataatacactggggtgcgacacggcccctggacaaggccttgagtggatagggaataacncaacctagtntagtgggtggacaanaagtctacgacaaacctcgttccgagggccaggacgtcaacctntagcgaaagggccacgccggacgtacacngttactagttacggatagaacgtatttaacgaatcgtagaaccgacgtcggtaccgttgtttaattggttagtagggcgtaacggaactacgttgtcggtccgtacgggtcgtcgtacgtccgtaccggttnttgttcccggtacccgggggtaccggtaacgggtacccgttccggtaaccgtcccgtttaccgtcccttaccggacgttacccccgacccaaaccggttaaccggcccctttaccggtccccgttcccgttacccccgccggtcccctaaccccgtcccttcgaaccgtacgacccctgttccgacgggtccacgacggccggcgtggccgtgccgtgtacacgtcgtaccgtcgcgtcgcgtccgtgtcggacggtcgtcgggtgaccgtacggccgtnacgtnancgnnn

SEQ ID NO: 147313 - DNA, 880 bp, Homo sapiens
  misc_feature: GYAE6OF01CTJ10.3.23.C01.1.454.CMB.1.raw
tcagagacgcactccacgaccggtgctcgatttagtacacgtgattagggattggggcctcagtgaaggtctcctgcaaggcgtctggatacgacgtcagcaggaggtatatacactgggtgcgacacggcccctggacaaggccttggaggtggagtgggaaataagtcctaaccctagtgagtgggtgcaacgaagctaacgacaaaccgtgttccgagggcaggacgtaccaaccgtatcgtaccgaaacgggaccgtaccgggacccgacgaaacaccgtagttaccttagtttacggaaacgtaggaaacgttaagttttaagaaacttcgtaacgtaccggaaccgaccggtacgtttagttagtttagttacggtcgaacggaaggtacctaagttccgtgggtaccggtccggtaagacgttcggtaccgttacggtcggttaacgttcgggtacggggacccgtaaccgggtaaccgtcggtaaccgtacccgttcttaccgccgtaaccgtcccgtacccgaaccggtaccggtaccctacggtttccccggttcccccgttaccccggtccggtaacccccttaccccgtacccgtaacccgaaccggtaaccgtaccccgtaccggttccgggtaccggggaccctaaaccggtccgggtaccccgggtacccggttcggggtacccgtttaccgggtacccggttaacggtaaccccggtaaaccggttcccgtttacccggttaccggtacgggttccgttacccggttccgtttacccggggcggtacccggggtcccgggttaacccggtcgggtaaccggacccgggtacgtaccgtaacggtacgtacgagcgtgacgtccg

SEQ ID NO: 147314 - DNA, 797 bp, Homo sapiens
  misc_feature: GYAE6OF01BY3PK.3.23.C01.1.454.CMB.1.raw
  modified_base (384)..(384): a, c, t, g, unknown or other
  misc_feature (384)..(384): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggcctccagacctacccccggagtaaactttcttttgacgcacgtctccgacggccacccttggttctttgtccgtccggagggggtagaggacgaccctaccctctccgtcgaccgacgggacccgtaaggtaccggtggttcgtacgacgtaccgaacgaccctaactaaccgttacggaccgtacggtaccctaaggccgaacggaccgtaccggtacggaccgtacggtccctaccgacggtccttaccccnctactccaggttcgggtacgctaaccgtaacccgtaaggacggtacccgtacggtcgaccaccgtaccgacgtacggtacggttacgacggtggtacgagggttcggtacgtacggaaactcggtacctcacctacgtaccgaccgtactacgacgacgtagtacggtcggtcgtaccgtaggtaccgttacgttacggttctttaacggtttacttacggtacgttacgtacgttacgtagttaacttaacggttaccggtaccggtaccggttacgggtaccgggttaccgggaaccggaacgggttaccggaaacggttaacgtaaaccgtaagtaaaccggtcggttaggtacgttcggactacccgtacgtacttacccggttcgtaaaccttccgtcccgttacccg

SEQ ID NO: 147315 - DNA, 506 bp, Homo sapiens
  misc_feature: GYAE6OF02I7WIF.3.23.C01.1.454.CMB.1.raw
  modified_base (501)..(506): a, c, t, g, unknown or other
  misc_feature (501)..(506): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctgggtcaccgtctcctcagcctccaccaggcccatcgtctcccctgcaccctcctccagacgcacctctggggcacagcggccctgggctgcctggtcaaggctacttccgagtcgcgtctctgagcgggctggcaaggcgcatagnnnnnn

SEQ ID NO: 147316 - DNA, 502 bp, Homo sapiens
  misc_feature: GYAE6OF02GSH1S.3.23.C01.1.454.CMB.1.raw
  modified_base (339)..(339): a, c, t, g, unknown or other
  misc_feature (339)..(339): n is a, c, g, or t
  modified_base (497)..(502): a, c, t, g, unknown or other
  misc_feature (497)..(502): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccaggggaaccctggtcaccgtctcctcagcctcaccaggcccatcgtctccctgcaccctcctccagacgcacctctcggggcacagcggcctggctgcctggtcaggactattccgagtgcgtctctgagcgggctggcgaaggcgcatagnnnnnn

SEQ ID NO: 147317 - DNA, 514 bp, Homo sapiens
  misc_feature: GYAE6OF02H3RXQ.3.23.C01.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccattagcctggtaccagcagagacctggccaggctcccaggcctcctcatccatggtncatccaacagggcccacgtggccatcccagacaggttcagtggcaggtgggtctggaacagtacttcactctcaccatcagcagactggacgcctagaagtactttgactagtttattactgttctgtctagtatggtacttcacttcttggtctagtttcggcggtcggacgaggtggagtatacaaacgactgnggtcngcacatctgtc

SEQ ID NO: 147318 - DNA, 518 bp, Homo sapiens
  misc_feature: GYAE6OF02ICWKH.3.23.C01.1.454.CMB.1.raw
  modified_base (313)..(313): a, c, t, g, unknown or other
  misc_feature (313)..(313): n is a, c, g, or t
  modified_base (394)..(394): a, c, t, g, unknown or other
  misc_feature (394)..(394): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgctccaggggagagagccaccctctcctgcagggccagtccgagtgtcagcagcaaccacttagcctggtaccagcagagacctggccaggcctcccgaggcctcctcatccatggtgcatccaacnggccacgtggcatcccagacaggttcaggtggcaggtgggtctagggaacagacttcactctcacatcagcagactggacnctagaagtactttgactagtttactactgtctgctagtatggtacttcacttcttggtactagttcggcgtcggacagggtggagtatacgaaacgtacgtggtcggctaggccactatctgtc

SEQ ID NO: 147319 - DNA, 522 bp, Homo sapiens
  misc_feature: GYAE6OF02HBVSE.3.23.C01.1.454.CMB.1.raw
  modified_base (339)..(339): a, c, t, g, unknown or other
  misc_feature (339)..(339): n is a, c, g, or t
  modified_base (513)..(513): a, c, t, g, unknown or other
  misc_feature (513)..(513): n is a, c, g, or t
  modified_base (517)..(522): a, c, t, g, unknown or other
  misc_feature (517)..(522): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccaggggaaccctggtcaccgtctcctcagcctccaccagggcccatccggtcttcccctggccacccctcctccagacgcacctctcgggggcacgacgcggcccgtgggctcgcctggtcaaggacctacgttccgagtcgcgtctctgagcgggctggcgaaggcgnatgnnnnnn

SEQ ID NO: 147320 - DNA, 579 bp, Homo sapiens
  misc_feature: GYAE6OF02GVX6D.3.23.C01.1.454.CMB.1.raw
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgattcgtggggccagggaaccctggtccaccgtctcctcacgccctccaccgacgggcccagtccgtccttcccctcggcctaccctccctaccaacgacgccacccgtcgtcggggcacgacgccggcccgtcgggcctcggccgtcggtaccgaacgggtaccttaccgtttcccgagttcggtccgttccgtcgtcggtacggccgggcgttcggccgaacgggccgcgtagtacgnagntngc

SEQ ID NO: 147321 - DNA, 734 bp, Homo sapiens
  misc_feature: GYAE6OF02HLXJQ.3.23.C01.1.454.CMB.1.raw
tcagagacgcactccacgaccggtgctcgatttagtacacgtgattagggattggggagagctgctcagttaggacccagagggaaccatggaaacccagcgcagcttctcttcctcctgctactctggctcccagactaccccggagaaattcttttgacgcagtctccaggcaccctgtctttgtctccgaggggagagagccaccctctcctgcgagggccagtccgagtgtcagcagcaaccacttacgctggtaccagcagagacctggccaggcctcccgaggtcctcctcactccagtcggtgccatcccaacgacgggcccacgtcggcactccccgaagactagggttcaggtcggactaggtcggggtctagggaaacaggtaccttacgaccttcctaccgaacctagttccaacggacgaacggaaccgttagggacgtaccgtaaggaaacgttccgttttaggaccgtttaagttttaacgtttaccgttgttaccgttagtaccgtaaggttaagttaccgggttaacctttaccgtaccgtttaccggtttacgggttaaccgttaaacggttttccggggacccggggtaaccggggtaaccggtaacggggttagggtaacggttaaacgttaaccggtaaaacggtaaccgttacggggttacggtaccgttacggtaacccgtaaccgttacgttaccggttacgtttacccgg

SEQ ID NO: 147322 - DNA, 735 bp, Homo sapiens
  misc_feature: GYAE6OF02IBA4G.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggcctcccaggcctcctcactccatggtcgcatcccaacgagggcccacgtgggacactccccgaagaccgaggtttccaaggttcgggcaggtggggtcctagggaaactaggacctttacgaaccttccgtaccgaaaccctagttaccgaaggtaccaacggtaaccgttggggaaccgtcccgttaagggaaacggttaccgtttttggaccttaacggtttttaactttaacccgttggttaccttggtaccgtaaggtttagtttaccgggttaaccttttacgtaaccgttttcgtttacgggtttaccttaaacggttttccgggaccgggttaaccggggtaaccctaaggggttcgggtaacggtaacgttaaccgtaaaaccgggtaacgttggttaccgggtacgtacgggtacctaacccgtagtttacccggttaggtttacccg

SEQ ID NO: 147323 - DNA, 535 bp, Homo sapiens
  misc_feature: GYAE6OF02H5TGM.3.23.C01.1.454.CMB.1.raw
  modified_base (362)..(362): a, c, t, g, unknown or other
  misc_feature (362)..(362): n is a, c, g, or t
  modified_base (530)..(534): a, c, t, g, unknown or other
  misc_feature (530)..(534): n is a, c, g, or t
tcagagacgcactccacgaccggtgctcgatttagtacacgtgatttagggtagttgggcctcagtgaaggtctcctggcaaggcgtactggagtacgacgtcagccaggaggtatattacactgggtgcgacaggccctggacaaggccttgaggtggatgggaataatcaaccctagtgtatggtggcacaagctacgcaaaccagttccagggcagagtcaccaatgtcaaagggcacggccgacgaacactagtctactttggaaactgaaagaattttagaaatcgtagacgacacggaccgtgtattattgtgtacgaggacaatctggtgccggtgactgcgtacgtcgatttcngggtcagggacctggtcacggtctctcagcctcaccaaggcccagtcgtctcccctggcacctcctccaagacgcacctcgtgggctacgagccgcctggctgccttggtcaaggtcctacttccgagtgccgtacgtctgacgcgggctcggcgaaggcgcatacgnnnnnc

SEQ ID NO: 147324 - DNA, 582 bp, Homo sapiens
  misc_feature: GYAE6OF02I9UD0.3.23.C01.1.454.CMB.1.raw
  modified_base (199)..(199): a, c, t, g, unknown or other
  misc_feature (199)..(199): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccacttagcctggtaccagcagagacctggccaggctcccgaggctcctcatccatggtncatccaacgagggcccacgtggcatcccagacaggttcaggtggcaggtggtctggaacagacttcactcncacatcagcagactggacgcctagaacgtactttgactagtttattacgtgtctgtctagttatggtacttctacttcgttggttactaagtttccgggacgggtaccgggtaaccgtaagggtggtaacggtaacgttaaccgaaaacggtaaccgttaggtacggtacgttacggaccctaaccgtacgttaccgttagttacccg

SEQ ID NO: 147325 - DNA, 568 bp, Homo sapiens
  misc_feature: GYAE6OF02HDJGR.3.23.C01.1.454.CMB.1.raw
  modified_base (199)..(199): a, c, t, g, unknown or other
  misc_feature (199)..(199): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccacttagcctggtaccagcagagacctggccaggctccaggctcctcatccagtggtgcatccaacacgggccacgtggcatcccagacaggttcaggtggctaggtgggtctgggacagtacttcactctcaccatcagtacgctagacgcctagaagtatttcgactagtcttattattgtacaactagtcgtggctaacgtcggccgtcgtcggacgttcggaccgaacgggtaccgaagggtaggaaacgtacgtaaaccggtaacgtacggtacggtacgtaggacctaaccgtattaccgttacggttcttacgtacg

SEQ ID NO: 147326 - DNA, 512 bp, Homo sapiens
  misc_feature: GYAE6OF02GJ7ZA.3.23.C01.1.454.CMB.1.raw
  modified_base (339)..(339): a, c, t, g, unknown or other
  misc_feature (339)..(339): n is a, c, g, or t
  modified_base (485)..(485): a, c, t, g, unknown or other
  misc_feature (485)..(485): n is a, c, g, or t
  modified_base (507)..(512): a, c, t, g, unknown or other
  misc_feature (507)..(512): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccaggggaaccctggtcaccgtctctcagcctcacaggcccatcgtctcccctggcaccctcctccagacgcacctctcggggcacgacgcggcccgtgggctcgcctggtcgaaggactacgttccgagtcgcgtctctgngcgggctggcgaggcgcagtgnnnnnn

SEQ ID NO: 147327 - DNA, 536 bp, Homo sapiens
  misc_feature: GYAE6OF02JAJ4R.3.23.C01.1.454.CMB.1.raw
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (533)..(534): a, c, t, g, unknown or other
  misc_feature (533)..(534): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtcatttggaactgaagaatttgaaatctgacgacacggccgtgtattattgtgcgaggacaatctgtgccggtgactgctacgtcgatttctggggccagggaaccctggtcaccgtctcctcagcctccaccaagggcccatcggtcttccccctggccacccctccctccaacgacgccacctcgtcggggcaccgagccggcccgtgggcctcgccgtggtcaaggtactacttccgagtgcgtctctgagcgggctcggctaagggccgcgagtacgncngcnncg

SEQ ID NO: 147328 - DNA, 598 bp, Homo sapiens
  misc_feature: GYAE6OF02H2Y0C.3.23.C01.1.454.CMB.1.raw
  modified_base (199)..(199): a, c, t, g, unknown or other
  misc_feature (199)..(199): n is a, c, g, or t
  modified_base (406)..(406): a, c, t, g, unknown or other
  misc_feature (406)..(406): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggangagccaccctctcctgcagggccagtccgagtgtcagcagcaaccacttagcctggtaccagcagagacctggccaggcctccaggcctcctcatccagtggtcgcaatccaacgacgggccacgtggacacgtcccaagacaggttcagtcggacaggtgggtctaggaacagtacttcgactctacaccatcagcagactggacncgtagaagtacttgactagtttattactgtactgactagttagttcggtacttcgtacttctttagggttaccttaaggtttcggaccgggtacgggtaacgtaagggttcggaacggtaactaaccggaaaccggtaacgttacggtcggtacgttacgggaccctaaccggtaattcccgttagttaccg

SEQ ID NO: 147329 - DNA, 556 bp, Homo sapiens
  misc_feature: GYAE6OF02FHDSB.3.23.C01.1.454.CMB.1.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagactggccaggctcccaggctcctcatccatggtgcatccaacngggccactggcatcccagacaggttcagtggcagtgggtctggaacngacttcactcncaccatcagcagactggacgcctagaacgtactttgctagtttatacttgtctgtcagttatggtacttcgtacttcgttggttactaagtttccgggcgggtaccgggtacctagggtggaagtaacgttaccgaaaacggtacgttggtaggtacgttcggacctaccgacgttccgttgttaccc

SEQ ID NO: 147330 - DNA, 548 bp, Homo sapiens
  misc_feature: GYAE6OF02G7738.3.23.C01.1.454.CMB.1.raw
  modified_base (543)..(548): a, c, t, g, unknown or other
  misc_feature (543)..(548): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccagggaccctggtcaccgtctcctcagcctccaccaacgggcccagtccggtccttcccccgtcggccacccctccctcccaagacgccaccctcgtcgggggccacgacggccgggcccgtcggggcctcggcccgtgggtccaacggacctacgttccgagtcgcgtctctgacggcgggctggcgaaggcgcatgnnnnnn

SEQ ID NO: 147331 - DNA, 578 bp, Homo sapiens
  misc_feature: GYAE6OF02F8T0C.3.23.C01.1.454.CMB.1.raw
  modified_base (573)..(578): a, c, t, g, unknown or other
  misc_feature (573)..(578): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccagggaaccctggtccaccgtctcctcagccctccaccgaagggcccagtccggtccttcccccgtcggcccaccccgtccctcccgaacgacgccacccgtcgtcgggggccacgacggccgggcccgtcgggccgtcgccgtcgggtccgaacgggtaccttaccgttccgacgtcgccgttcgtcgtcgacggcgggcgtcgggacgaacgggcgacgagtacgnnnnnn

SEQ ID NO: 147332 - DNA, 508 bp, Homo sapiens
  misc_feature: GYAE6OF02GGUWB.3.23.C01.1.454.CMB.1.raw
  modified_base (199)..(199): a, c, t, g, unknown or other
  misc_feature (199)..(199): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (441)..(441): a, c, t, g, unknown or other
  misc_feature (441)..(441): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccacttagcctggtaccagcagagacctggccaggctcccaggctccncatccatggtgcatccaacnggccactggcatcccagacaggttcagtgcagtgggtctggaacagactcactctcaccatcagcagactggagcctagaagtactttgactagtttactactgttctgactagtatggtacttcacttnttgtactaagtttcggcgtcggacgtaggtgagtagtacgaaacgactgtgcgtgacacactctgtc

SEQ ID NO: 147333 - DNA, 513 bp, Homo sapiens
  misc_feature: GYAE6OF02GOAE4.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtgcatccaacagggccactggcatcccagacaggttcagtgcagtggtctggaacagacttcactctcaccatcagcagactggagcctgaacgtactttgctagtttatactgtctgctagttatggtacttctacttcttggtctaagtttcggcggtcgggacctaggtggagatacgaaacgaacttggtggctgaccacattctgttc

SEQ ID NO: 147334 - DNA, 523 bp, Homo sapiens
  misc_feature: GYAE6OF02FX6UC.3.23.C01.1.454.CMB.1.raw
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtncatcccaacagggccactggcatcccagacaggttcagtggcaggtggtctggaacngaccttnactctcaccatcagcagactggancctgaagtactttgctagtttattactgtctgntagtagtggtacttctacttcgttgtactagtttcggcggacgggtaccagggtggagtagtacgaaacgtacgtgtaggtctcgaccacacgttctgtc

SEQ ID NO: 147335 - DNA, 541 bp, Homo sapiens
  misc_feature: GYAE6OF02GUBCA.3.23.C01.1.454.CMB.1.raw
  modified_base (532)..(532): a, c, t, g, unknown or other
  misc_feature (532)..(532): n is a, c, g, or t
  modified_base (536)..(541): a, c, t, g, unknown or other
  misc_feature (536)..(541): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctggtcaccgtctcctcagcctccaccaagggcccagtccggtcttccccctggccacccctccctcccaacgacgccaccctccgtcgggggccaccgacgccgggccctggggcctcggccgtgggtccaaggacctacttccgagtcgcgtctctgacgcgggctggcaaggcgnatgnnnnnn

SEQ ID NO: 147336 - DNA, 623 bp, Homo sapiens
  misc_feature: GYAE6OF02F16TK.3.23.C01.1.454.CMB.1.raw
  modified_base (214)..(214): a, c, t, g, unknown or other
  misc_feature (214)..(214): n is a, c, g, or t
  modified_base (612)..(612): a, c, t, g, unknown or other
  misc_feature (612)..(612): n is a, c, g, or t
tcagagacgcactccacgaccggtgctcgatttagtacacgtgatttaggggtagttggggccttacagtgtaaggtctccgtgcaaggcgtctggatacgaacgtcagcaggaggtatagtacactgggtgcgacaggcccctggacaaggccgtttgagtggatgggaataagtcaaccctagtgagtggtaggcacaagctacgcaaaccngttccagggctagagtcaccatgtccaagggacacggccgcgaacacagtctagtttcggaactgaagaatttgaatctgacgacacggccgtagtattattgtagcgaggacaatctgtagccggtgactgctacgtcgatttctcggggccagggtaccctggtcgaccgtctctcagcctccaccagggcccagtcggtccttcccctggtccaccctcctcccaacgacgccacccgtcgtcgggggacctacgacgccggacccgtcgggcctcgccgtacggttacctaacggaccttaacgttacccgagtcggtaccgttaccttaccgttacgacggtaccgggtcgtacgggaccgtaacgggaccggaccgtaacgtacggacacgngacgacgtacg

SEQ ID NO: 147337 - DNA, 564 bp, Homo sapiens
  misc_feature: GYAE6OF02GG5R7.3.23.C01.1.454.CMB.1.raw
  modified_base (199)..(199): a, c, t, g, unknown or other
  misc_feature (199)..(199): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagcaaccacttagcctggtaccagcagagacctggccaggctcccaggcctcctcatccatggtgcactcccaacgagggcccacgtggccatcccagacaggttcaggtggcaggtcgggtctaggaacagacttcactctcacccatcgagcgagactgggacgcctagaaacgtctttgacttagttttaacttacttgttctgactaggttattggtacttctacttcgtttggtacttaaggttccggcgggaccgggtacgtagggtggagtaactacgaaacgtacgtggtggactcggactacctattccgtgttacc

SEQ ID NO: 147338 - DNA, 674 bp, Homo sapiens
  misc_feature: GYAE6OF02I3WKZ.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagcccaccctctcctgcagggccagtccgagtgtcagcagccaaccacttagcctggtaccagcagacgacctggccagggctccccgaggcctcctcactccagtggtcgctactcccaaacgcgggccactggaccactcccagactaggttcaggtggctagggtcgggtctagggaacctaggtacttcgaacttccgtaccaaccagttcgaacgcaacggtacgtaggacgccgttaggtaaacgttacgtttacggacgttaaggttttaactttacgttcggttacttcggtacgtaaggtttacgttcggttaaccctttacgtaccgttttcgtttaggttaccgtttaaacggtttccgggtacggggtaccgggtaccgtaggggtggaacgtacgttaaccggaaacggtagttacgggttcggaccgttcggaccgtaccctacgttccgttggttacc

SEQ ID NO: 147339 - DNA, 526 bp, Homo sapiens
  misc_feature: GYAE6OF02F00M7.3.23.C01.1.454.CMB.1.raw
  modified_base (521)..(526): a, c, t, g, unknown or other
  misc_feature (521)..(526): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctggtcaccggtctcctcagcctccaccaaggggccccatccggtcttccccctggccacccctccctccaacgagccacctcctggggcacagccggccctgggcctgcctggtcaaggacctacttccgagtgcgtctctgacgcgggctggcaaggcgcatagnnnnnn

SEQ ID NO: 147340 - DNA, 523 bp, Homo sapiens
  misc_feature: GYAE6OF02FIQ58.3.23.C01.1.454.CMB.1.raw
  modified_base (513)..(513): a, c, t, g, unknown or other
  misc_feature (513)..(513): n is a, c, g, or t
  modified_base (518)..(523): a, c, t, g, unknown or other
  misc_feature (518)..(523): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccagggaaccctggtcaccgtctcctcagcctccaccaagggcccatccggtcttccccctggccaccctccctccaagacgccaccctctcgggggcacgacgccggccctgggcctgcctggtcaaggactacttccgagtgcgtctctgagcgggctggcaaggcgnatagnnnnnn

SEQ ID NO: 147341 - DNA, 535 bp, Homo sapiens
  misc_feature: GYAE6OF02HXSXW.3.23.C01.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggganagagccaccctctcctgcagggccagtccgagtgtcagcagccaaccacttagcctggtaccagcagagacctggccaggcctcccaggcctcctcatccatggtgcatccaacgngggccacgtggcactcccaagacaggttcaggtggctaggtgggtctaggaacagtacttcactctccaccatcagcagacgtggacgctagaagtactttgactagtttattactgttctgctagttagtcgttacttctacttcgttgtactaacgttcggacggtcggaacgtaggtggagaatacgaaacgacgtagtggctgactacgatctgtc

SEQ ID NO: 147342 - DNA, 525 bp, Homo sapiens
  misc_feature: GYAE6OF02GNKFH.3.23.C01.1.454.CMB.1.raw
  modified_base (497)..(497): a, c, t, g, unknown or other
  misc_feature (497)..(497): n is a, c, g, or t
  modified_base (520)..(525): a, c, t, g, unknown or other
  misc_feature (520)..(525): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcataagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctgggtcaccgtctcctcagcctccaccaagggcccatccggtccttccccctggccacccctcctccaagacgcaccctctcggggcacagcggccctgggcctcgcctggtcaaggacctacttccgagtcgcgtctctgnggcgggctggcaaggcgcatagnnnnnn

SEQ ID NO: 147343 - DNA, 603 bp, Homo sapiens
  misc_feature: GYAE6OF02J2IM0.3.23.C01.1.454.CMB.1.raw
  modified_base (592)..(592): a, c, t, g, unknown or other
  misc_feature (592)..(592): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
tcagagacgcactccacgaccggtgctcgatttagtacacgtgattagggattggggcctcagtgaaggtctcctgcaaggcgtctggatacgacgtcagcaggaggtatatacactggggtgcgacaggcccctggacaaggccttgagtggatgggaataatcaaccctagtgatggtggcacaagctacgcaaaccagttccgagggcagagtcaccatgtcaagggacacggccgcgaacacagtctatttggaactgaagaatttgaaatctgacgacacggccgtgtattatgtgcgaggacaatctgtgccgtgactgctacgtcgattcgtggggccagggaaccctgggtccaccgtctccgtacacgcccttaccaccgaacgggccctagtccggtaccttcccccgtggccacccctcccgtccgaacgtacgcctaaccctcggtcggggaccacgtacggcccggccgttacggggccttcggcccgtacggtaccgtaacggtaccttaccgttccgacgttcccgtcgtccgtacggacggccgggcgtcggccgtaacggccgtaccagtacgcncgagcncgcnc

SEQ ID NO: 147344 - DNA, 532 bp, Homo sapiens
  misc_feature: GYAE6OF02HKTTQ.3.23.C01.1.454.CMB.1.raw
  modified_base (202)..(202): a, c, t, g, unknown or other
  misc_feature (202)..(202): n is a, c, g, or t
  modified_base (286)..(286): a, c, t, g, unknown or other
  misc_feature (286)..(286): n is a, c, g, or t
  modified_base (391)..(391): a, c, t, g, unknown or other
  misc_feature (391)..(391): n is a, c, g, or t
tcagagacgcactccacgaccggtgctcgatttagtacacgtgattagggattgggggagagctgctcagttaggacccagagggaaccatggaaaccccagcgcagcttctcttcctcctgctactctggctcccagatacccccggagaaattcttttgacgcagtctccaggcaccctgtctttgtctccaggggaaangccacatctcctgcagggccagtcagactattagaagcaacttagcctggtaccagcagaaacctggccaggctccaggctccncatctatggtgcatccacacggggccacgtggtactcccgagcccagggttccaggttggctaggtgggtctggggacagtacgtttcacttctcaccatcagcngcctgctagtctagatatttgacttacttttattctgtcagctagtataatactggccttcgtggacgttcgggcgggtaaccagggtgaagatacgaacgatggtgctcgcaccgtatctagtattccattccctaccgc

SEQ ID NO: 147345 - DNA, 715 bp, Homo sapiens
  misc_feature: GYAE6OF02ISY27.3.23.C01.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
tcagagacgcactccacgaccggtgctcgatttagtacacgtgattagggattgggggagagctgctcagttaggacccagagggaaccatggaaaccccagcgcagcttctcttcctcctgctactctggctcccagactacccccggagaaattcttttgacgcagtctccaggcaccctgtctttgtctccgagggganagagccaccctctcctgcgagggccagtccgagtgtcagcagccaaccacttagcctggtaccagcagagacctggccaggcctacccgaggcctcctcaactccagtcggtnccaatcccaaacgagggccacgtggaccactcccgaagacgtacggttcgaggtcggactagggtcgggttactagggaaactacggtacctttcaaccttcccgtaccaacctattccgaacgaccgtaacggtaacgtagggacgtaccgtaaggtaaacgttaccgttttaggaccgtttaaggttttaactttaccgttgttaccgttagtacgtaagtttagttacggtttaaccttccgttacgtttccgtttacggttacgttaaacggtttccgggaccgggtacgggtaaccgtaagggttacggtaacgtaaccgttaaccggaaaacggtaacgttacgggtacggtaccgtacggtaaccctaaccggtacttccgttacgtttaccg

SEQ ID NO: 147346 - DNA, 556 bp, Homo sapiens
  misc_feature: GYAE6OF02IF44X.3.23.C01.1.454.CMB.1.raw
  modified_base (550)..(551): a, c, t, g, unknown or other
  misc_feature (550)..(551): n is a, c, g, or t
  modified_base (554)..(556): a, c, t, g, unknown or other
  misc_feature (554)..(556): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgcggtgactgctacgtcgatttcgtggggccaggggaaccctgggtccaccggtctcctcacgccctccgaccaacggcccagtccgtccttccccgtcggcctacccctccctcaacgacgccacctcgtcggggccacgacgccggcccgtggccgtgccgtggtaccgacggtacctaccgttccgacgtgccgttcgtcgtcgcggcgggcgtcggcgaggcgcgtagacgnngcnnn

SEQ ID NO: 147347 - DNA, 571 bp, Homo sapiens
  misc_feature: GYAE6OF02F01R6.3.23.C01.1.454.CMB.1.raw
  modified_base (199)..(199): a, c, t, g, unknown or other
  misc_feature (199)..(199): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(571): a, c, t, g, unknown or other
  misc_feature (569)..(571): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccngttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccagggaaccctggtccaccgtctcctcacgcctccaccgaacgggccccagtccggtccttcccccgtcggcctaccctccctccaacgacgccaccgtcgtcggggccacgacgccggcccgtcgggccgtcggcccgtggtccgaacggtaccgttaccgttccgacgttcgtcgtcgtgacggcgggtcgtcggcgaacgggccgtacgagtacgncgncnnn

SEQ ID NO: 147348 - DNA, 576 bp, Homo sapiens
  misc_feature: GYAE6OF02IVYL4.3.23.C01.1.454.CMB.1.raw
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctccgaggctcctcatccatggtgcatcccaacaggggccacgtcggcactcccagacaggttcagtgcagtggtctggaacngactcactctcactancagacagacgtggacgcctagaagtacttgactagtttacttactgttctgtacagttagtcggttacttctacttcgttagtacttaacggttcggccgggtacggggaacctagggtacggtagtaacgtaccgaaaaacggtaacgttcggttacggtccgtacggaaccctaccgtacgttcgtacgtttacccg

SEQ ID NO: 147349 - DNA, 752 bp, Homo sapiens
  misc_feature: GYAE6OF02H8KTY.3.23.C01.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
  modified_base (740)..(740): a, c, t, g, unknown or other
  misc_feature (740)..(740): n is a, c, g, or t
tcagagacgcactccacgaccggtgctcgatttagtacacgtgattaggattgggcctcagtgaaggtcgtcctgcaaggcgtctggatacgacgtcagcaggaggtatatacactgggtgcgacaggcccctggacaaggccttgagtggatgggaatatcaaccctagtgatggtgcacaagctacgcaaacngtccaggcagagtcacatgtcaaggacacggcgacgaacacagtctacgtttggaactgaacgaatttgaaaatctagacgactacggacctgttattaattgngacgaggacaaagtctgtagcccggtagtaaccgtgtccgtaacggtccgtaagtttccgtagggggaccctaacgggggtaaacccttgggtaacctacccggtttaccctccgtacgtaaccggccccttacccgaacccggtaaacggggtccccaaggtttccccgggttaccctttcccccggttccggtaccccgtaacccccttccccgtaaccgtaaaccggtaacgtacccgtacccgtcccggttacgggggacccttaacccggaacggtccccgggtacccgttacggggcccttcgggtacccttcgggttacccgaaacgggttacccgtacccgtttaccgaacggttcgtccgttaccgttcccgtacgggtacggcggggtccgttcggaccgttaacgggccgtaccgtacgttaacggccgngtcgcggactcg

SEQ ID NO: 147350 - DNA, 597 bp, Homo sapiens
  misc_feature: GYAE6OF02GPR76.3.23.C01.1.454.CMB.1.raw
  modified_base (596)..(597): a, c, t, g, unknown or other
  misc_feature (596)..(597): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctgacgacacggccgtgtattattgtgcgaggacaatctgtgccggtgactgctacgtcgatttctggggccaggggtaaccctgggttcaccggtctcctcacgcctccaccgaagggcccagtccggtccttccccctggcctacccctcctccaacgacgccaccgtcgtcgggggccacgacggccggcccgtcgggcctcggcccgtcgggttaccgaaagggtaccttaccgtttcccggacgttacggccgttccgttccgttcggacggtccggggtccgttcgggacgtaacgggccgcgtacgtagctagctcgnn

SEQ ID NO: 147351 - DNA, 583 bp, Homo sapiens
  misc_feature: GYAE6OF02F03Z3.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggcctcccgaggcctcctcactccatggtgcatcccaacgacgggccacgtggacactcccgaagaccgtaggttcaggtcggactaggtcgggtctaggaactagacttcactctacaccatcagacagacgtggacgcctagaacgtactttgacttagtttactactgtctgtctagtactaggtacttctacttcgttagtactaagtttccggcggtaccgggtaaccgtagggtaggtaacgtaactaaccggaaacgtaacgtggtacggtcgttacggacctaccgtattcgtgttacc

SEQ ID NO: 147352 - DNA, 581 bp, Homo sapiens
  misc_feature: GYAE6OF02HVAVX.3.23.C01.1.454.CMB.1.raw
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
  modified_base (547)..(547): a, c, t, g, unknown or other
  misc_feature (547)..(547): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccagggagagagccaccctctcctgcagggccagtccgagtgtcagcagcaaccacttagcctggtaccagcagagacctggccaggcctcccaggctcctcatccatggtgcatccaacgagggccaagtcggcactcccaagacgaggttcagtggactaggtcgggtcagggaacaggacttcgactctacacactcagacacgcgtaggacnccgtaggaaactcgtttgacctagttttaacttactgttacnggtacaagttgtacggttacttctacttcgttcgtacttaagttcgggacgtaccgggtactaggggtagacgaagttaaccgaaacggtaacttcggngtacgtcggacctaaccgtattccgtgttacccg

SEQ ID NO: 147353 - DNA, 724 bp, Homo sapiens
  misc_feature: GYAE6OF02F26UM.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaatttcttttgacgcagtctccaggcaccctgtctttgtctccaggggagagagccaccctctcctgcagggccagtccgagtgtcagcagcaaccacttagcctggtaccagcagacgacctggccaggcctccccgaggcctcctcatccagtggtcgcactacccaaacgacgggcccaacgtggaccacgtcccaagtaccgtagggttacaggttcggacgtagggtacggggtcgtaagggaactacggaccttacaccttccgtaccaaccctatccgaagtccgaggtacgttcgggacgtaccgtaaggtaaacgttacgttttagaccgtttaagtttacttacgttacgtcgttacgacttaaagggttcgttaacggttacctttacgtaccgttttacggtttacggttaaccgtttaaaggtttcccggggtaccggggtaaccccggggtaacgttaacgggggttacgtaaggttaaaccggtaaaccgttaaaacggtacggttacggttacggtacggttacgtacccgtaacgttacgttaccgttacggttccc

SEQ ID NO: 147354 - DNA, 516 bp, Homo sapiens
  misc_feature: GYAE6OF02HAUZJ.3.23.C01.1.454.CMB.1.raw
  modified_base (511)..(516): a, c, t, g, unknown or other
  misc_feature (511)..(516): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctggtcaccgtctcctcagcctccaccaagggcccatcggtcttccccctggcaccctcctccaagcgcacctctcgggggcacgagccggccctgggcctgcctggtcaacggctacttccgagtgcgtctctgagcgggctggcaggcgcatagnnnnnn

SEQ ID NO: 147355 - DNA, 730 bp, Homo sapiens
  misc_feature: GYAE6OF02JDNEW.3.23.C01.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
  modified_base (326)..(326): a, c, t, g, unknown or other
  misc_feature (326)..(326): n is a, c, g, or t
tcagagacgcactccacgaccggtgctcgatttagtacacgtgattagggagttggggagagctgctcagttaggacccagagggaaccatggaaaccccagcgcagcttctcttcctcctgctactctggctcccagataccccggagaaattcttttgacgcagtctccaggtcaccctgtctttgctccgagggganagagcccaccctctcctgcagggccagtccgagtgtcagcagcaaccgacttagcctggtaccngcagacgacctggaccaggcctcccgaggtcctcccgtacaacgttcccgagttcgggtacnccgaacttccccgaaacgacgggggccccaacgttcgggacctacgttacccccgaaggtaaccctaacggggtttccgaacggttcggggactaagggttcgggggttactaacggggaaaactacgtaccgtttccaaaccgttcctacccgaaccgtaacttccgaacgtaccgtaacggtaaccggttacgggaacggtacccgttaagggtaaacggtttaacggtttttacgaccgttacgttaccgtttaacgttttacgttacgtaaccgtaacgtacggtaccggtacggtaccgtaacgtccgtaccgtcggtacgtaccgtcggacgacggacgtagacggacgtaacgaacgtacgtacgtacgtctacgacgtaccacgtcgttcgtctcg

SEQ ID NO: 147356 - DNA, 754 bp, Homo sapiens
  misc_feature: GYAE6OF02JHFZ7.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagataccccggagaaattcttttgacgcagtctccaggcaccctgtctttgtctccgaggggagagacgccaccctctcctgcgacgggccagtccgagtgtcagcagcaaccacttacgcctggtaccagccagacgacctggaccaggcctacccgaggtcctcctcactccagtggtcgcatccgaacgacgggccacgtcggaccagtcccagactagggtccaggttcgacgtaggttcggcgtacggaactagactttacactctacacactacgagtaccagacgttgacgcctaggaacttcgttagacttaaggtttactttacgtacgttcgtacgtactacggtttaacgttaccggtttaacttacccgtaacgttttaccggtttaacgggtttacccgttaaaacgggtttttcccggggtacccgggggtaaccggggtttaaaccccgtaggggggttttaccgggtaaaacggtttaaccggtaaaacccggtttaaaaaccggggtaaaccggtttcccggggtaagggtttaccccggtttaaccggaccccgggtttaacccgtaaaccggtttttccggttaaaccccggtttcccgg

SEQ ID NO: 147357 - DNA, 585 bp, Homo sapiens
  misc_feature: GYAE6OF02GPHKM.3.23.C01.1.454.CMB.1.raw
  modified_base (422)..(422): a, c, t, g, unknown or other
  misc_feature (422)..(422): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgtatttcgcggggccgacgggaaccctggtccaccgtctcctcacgccctccaccgaacgggccccagtccggtccttcccccgtgcccncccctcccgtcccaagacgccaccctcgtcggggcacgacgccggcccgtcgggcctcggcccgtcggtaccgaacggtaccgttaccgttacccgacgtcgtccgtccgttccgtcggcggccggggtcgtcgggccgacgggcgacgacgtgcgncgngnc

SEQ ID NO: 147358 - DNA, 579 bp, Homo sapiens
  misc_feature: GYAE6OF02F6JG2.3.23.C01.1.454.CMB.1.raw
  modified_base (572)..(572): a, c, t, g, unknown or other
  misc_feature (572)..(572): n is a, c, g, or t
  modified_base (575)..(577): a, c, t, g, unknown or other
  misc_feature (575)..(577): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgtggggccagggaaccctgggtcaccgtctcctcacgccctccaccaacgggccccagtccggtccttcccccgtcggcccacccctccctcccaacgacgccacccgtcgtcggggaccacgacggccggcccgtcgggcctcgccgtcggtcgaacggtacctaccgttccgagtcgcgtccgtctggacggtccgggtcgtcgggacgtaacgggccgacgacgtacgcgngcnnncg

SEQ ID NO: 147359 - DNA, 602 bp, Homo sapiens
  misc_feature: GYAE6OF02HXPG7.3.23.C01.1.454.CMB.1.raw
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
tcagagacgcactccacgaccggtgctcgatttagtacacgtgattagggattggggagagctgctcagttaggacccagagggaaccacggaaaccccagcgcagcttctcttcctcctgctactctggctcccagatacccccggagaaattcttttgacgcagtctccaggcaccctgtctttgctccagggganagagccacctctcctgcagggccagtccgagtgtcagcagcaaccncttagcctggtaccagcagacgacctggccaggcctcccgaggctcctcattcatggtncatctaacgnggtccatggctatccagccaggttcagtcggcagtgatagtgggacaggtacttcgacctctcacctatccagcaatctgcagtactagaagttcttttagacttaagttttactttacgtcgtactagtactaagtttaaccaccgttggtcccttagggttaacgttttcgggaacccgtaggggtaacctaggtacgtacggacggtacgtaacccgaaacggtaacttcgggtacggtaccgtacgacccgtaacccgtacgtttacgttaccgtcctttaaccg

SEQ ID NO: 147360 - DNA, 792 bp, Homo sapiens
  misc_feature: GYAE6OF02IFOON.3.23.C01.1.454.CMB.1.raw
tcagagacgcactccacgaccggtgctcgatttagtacacgtgattagggattgggggagagctgctcagttaggacccagagggaaccatggaaacccagcgcagcttctcttcctcctgctactctggctcccagactaccccggagaaattcttttgacgcagtctccaggcaccctgtctttgtctccgaggggagagacgccacccttctcctgcgacgggccacgtccgagtgtcagcaagccaaccacttagaccgtggtaccagcagacgacgtcggccgaggcctaccgacggtcctccctcgacttcccgagtgggtcgcctaactacccaaaccgacggggacccaccgtagggacctaactaccccgaggaaccgtacgggtttacgaacggtcgggaccgtaagggttcggggtacctaagggaaacgtaacggtaaccgtttaccaaaccgttccttaaccccaaccgtacgttacccgaaggtaccgaaacggtacgttacgggacgtacccgttaaaggtaacgttaccgtttaggtacccgttaaaggttttaacctttaacggtcgttcgttaacgtacgttaaacggtttacgttaccggttttaaccttacgttaccgtttaaccggtttcggttaaactttaaccgggttcgggtaacccgggttaacggggaaacccgttaggggtaccgggtaaacaggtaaacctaacgggaaccgtttaggccggtactaacggacccgttaaccgtacgttaccgttcgttacccg

SEQ ID NO: 147361 - DNA, 566 bp, Homo sapiens
  misc_feature: GYAE6OF02JD2H8.3.23.C01.1.454.CMB.1.raw
  modified_base (200)..(200): a, c, t, g, unknown or other
  misc_feature (200)..(200): n is a, c, g, or t
  modified_base (342)..(342): a, c, t, g, unknown or other
  misc_feature (342)..(342): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (560)..(561): a, c, t, g, unknown or other
  misc_feature (560)..(561): n is a, c, g, or t
  modified_base (563)..(566): a, c, t, g, unknown or other
  misc_feature (563)..(566): n is a, c, g, or t
tcagagacgcactccacgaccggtgctcgatttagtacacgtgattagggagttggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccngttccagggcagagtcaccatgtcaagggacacggccgcgaacacagtctatttggaactgaagaatttgaaatctagacgacacggcgtgtattattgtgcgaggacaatctgtcgccggtgactgctacgtcgatttcgnggggtccaggggaaccctggtccaccgtctcctcacgtcctccaccgaacgggcccagttccggtccttccccgtcgccncccctctccaagcncctacctcgtcggggcacgacgccggcccgtgggcctcggccgtcggtaccgaacggtaccttacgttccgtacggtcgccgttctcgtgacggcgggtctcgggacgacgggccgctagtcgnngnnnn

SEQ ID NO: 147362 - DNA, 801 bp, Homo sapiens
  misc_feature: GYAE6OF02J22DC.3.23.C01.1.454.CMB.1.raw
  modified_base (90)..(90): a, c, t, g, unknown or other
  misc_feature (90)..(90): n is a, c, g, or t
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
  modified_base (792)..(792): a, c, t, g, unknown or other
  misc_feature (792)..(792): n is a, c, g, or t
  modified_base (797)..(797): a, c, t, g, unknown or other
  misc_feature (797)..(797): n is a, c, g, or t
  modified_base (799)..(800): a, c, t, g, unknown or other
  misc_feature (799)..(800): n is a, c, g, or t
tcagagacgcactccacgaccggtgctcgatttagtacacgtgattagggagttggggcctcagtgaaggtctcctgcaaggcgtctggntacgacgtcagcaggaggtatatacactgggtgcgacaggcccctggacaaggccttgagtggatgggaataatcaaccctagtgatggtggcacaagctacgcaaaccagttccgggcagagtcaccatgtacaagggacacggccgacgaacacagtctagtttggaactgaaataagtttcgaaatcgtgacgacncgggcctgtaactttagtgtcgacgaaggactaagtctggtcgccgggttnacgttgcgtaccggtcgtagtttcggtacggggaccacggggtaaccccttgggtacccgtacccggttcttcccgtaccgacggtcccctaccccgaaacccggtaaaccggggtccccctaaggtttcccccgggttacccgtttccccccggtaccgggtccccgtaaaccccccgttccccgttaaccccgaaacggtacccgtacccgttaaccccgttcggttaccgggggacccgtaaccgtaccgggtaccccgggtcccccggtacgggtcccggtccgggtaccccgttaggggttacccgggtaaaccgggttaacccgtttaacccggttaccggttaaccggttccgggtcccgttaccggtccgttaccgggtacggcccggggttaccggtccgggtaccgaaccggggtcccgtacggaaccgttacggcgttcgngtcgngnng

SEQ ID NO: 147363 - DNA, 601 bp, Homo sapiens
  misc_feature: GYAE6OF02I3YC1.3.23.C01.1.454.CMB.1.raw
  modified_base (303)..(303): a, c, t, g, unknown or other
  misc_feature (303)..(303): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagccaaccacttagcctggtaccagcagagacctggccaggctcccaggctcctcatctatggtncatccgacccgggcactgactcccagcctaggtcagtggctaggtcgggtctcggacagtacgttcacgtctcaccatcagcacgcctggacgtctagtaacgactctacgtactagtttattactgtcagtctaagtattaacttcgtaggtccggttcggtacggttaccggaaccggtaacgggaacccgtaaagggtacggtaaacgtaccgtaaaacgtacgttacgggtacggtacgtacgaccgttaccgtacgttcgttaccgttcctttacgtcctttccgttaccccg

SEQ ID NO: 147364 - DNA, 655 bp, Homo sapiens
  misc_feature: GYAE6OF02FYV7C.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagacgacctggccaggcctcccaggcctcctcactccagtggtcgcactcccaaacgcggggccacgtggacactcccagacaggttcaggtcggcgtaggtcggtacgtaggaaactaggtacctttccgaacttcctaccaacctagtcgacgcgagtaacgtggacgtaccgtaggtaaacgtacgtttcggacttaaggttttaacttacgttgttcctgtcctaaggttacgttacggttactttacgtaccgtttcgttacggttaccttaaaggtttccgggtaccgggtaccgggtaaccgtaggggttacggacggtaacgtaaccgaaacggtaacgtcggttacggcgtacggacctaccgtacgttccgttacgttaccg

SEQ ID NO: 147365 - DNA, 599 bp, Homo sapiens
  misc_feature: GYAE6OF02FHM6D.3.23.C01.1.454.CMB.1.raw
  modified_base (421)..(421): a, c, t, g, unknown or other
  misc_feature (421)..(421): n is a, c, g, or t
  modified_base (592)..(592): a, c, t, g, unknown or other
  misc_feature (592)..(592): n is a, c, g, or t
  modified_base (597)..(597): a, c, t, g, unknown or other
  misc_feature (597)..(597): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgtagtttctggggccaggggtaccctggtccaccgtctcctcacgccctccaccaacgggccccagtccggtccttcccccgtcggccnccccgtccctccaacgacgccaccctcgtcggggcacgacggcccggcccgtcgggctcgtccgtcggtccgaacggaccgttaccgttaccggacgttcggcccgtcgttccgttcgacggtccggggtcgtcgggtacccggaagggtccgaccggacgttaacggcgngcagncg

SEQ ID NO: 147366 - DNA, 583 bp, Homo sapiens
  misc_feature: GYAE6OF02FWC3Q.3.23.C01.1.454.CMB.1.raw
tcagagacgcactccacgaccggtgctcgatttagtacacgtgattagggagttggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtagccggtgactgctacgtcgatttcgtggggccagggaccctggtcaccgtctcctcagcctccaccaacgggcccagtccggtccttccccgtggcccaccctccctccaacgacgccacctcgtcggggcacgacggccgcccgtggccgtgccgtcggtccgaacgggtacctaccgtttccggagttcggtaccgttccgtcgtaggacggccggggtcttcgggaccgaacgggccgacgtagtaacggctacgacgtcagcg

SEQ ID NO: 147367 - DNA, 661 bp, Homo sapiens
  misc_feature: GYAE6OF02ILDEQ.3.23.C01.1.454.CMB.1.raw
  modified_base (198)..(198): a, c, t, g, unknown or other
  misc_feature (198)..(198): n is a, c, g, or t
  modified_base (346)..(346): a, c, t, g, unknown or other
  misc_feature (346)..(346): n is a, c, g, or t
  modified_base (657)..(657): a, c, t, g, unknown or other
  misc_feature (657)..(657): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccngttccagggcagagtcaccatgtcaagggacacggccgacgaacacagtctattggaactgaagaatttagaaatctgacgacacggccgtgtattattgtgcggaggacaatctgtgcgggtgactgctacggtcgtaagttttcgnggggccaacgggaacccttgggtcctaccgtctcctcacgccctccaacccgacggccccacgtccggttcctttcccccgtacgccctacccctccctacccgaacgacgtaccacccgttcggtaccggggccgaaccgaacggcccggcccggtaccgggcgtcgcccggtacggtcgtaaacgggtacgttaaccgttacccggtacggttacggtcccgttaccgttaccggttcggtaccgggtcggggtcccggttcggggacccggtaacgggcccggtacgacgtttaacgccgtggcgtcncgcg

SEQ ID NO: 147368 - DNA, 579 bp, Homo sapiens
  misc_feature: GYAE6OF02GUEMQ.3.23.C01.1.454.CMB.1.raw
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (571)..(571): a, c, t, g, unknown or other
  misc_feature (571)..(571): n is a, c, g, or t
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagaatttgaaatctagacgacacggccgtgtattattgtgcgagacaatctgtcgccggtgactgctacgtcgattttcgnggggccaggggtaaccctggtcaccgtctcctcncgcctccaccgacggcccagtccggtccttcccccgtcggaccacccctccctacccaacgacgccaccgtccgtcggggccaccgcgccggcccgtacgggccgtcggcccgtggtaccgaacggtaccttaccgttccgtagtcggccgtctcgtgacggcggtcgtgggccgaagggtccgacgaacgtcggnagcgnngn

SEQ ID NO: 147369 - DNA, 861 bp, Homo sapiens
  misc_feature: GYAE6OF02HL4PF.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggcaccctgtctttgtctccgaggggagagacgccaccctctcctgcgagggccagtccgagtgtcagcagcaaaccactagcctggtaccagcagacgacctggccaggcctcccgaggtcctcctcaactcccgaagtcgggtgcctaactacccgaaacgacggggtcccaacggttcggacctactaccccgagaaccgtacgggtttaccaaggttcgggactaacggggttcggggtaccttaacggggaaaactacgggtaacctttaccgaaccgttccgttacccgaaccctagttacccgaacggtaccgtaacgggtaccgttacggggaaccgtacccgttaaaggaaaacggtttaaccgttttacgggtacctttaaagggttttttaactttaacccggttgtttacccgttgggtaaaccgtttaacgggtttaacgtttacccgggtttaaaccttttaccgttaaccgtttacgtttttaaccggggttaccttttaaaccggggttttcccggggtaacccggggtaccggggttaaacccgggtaagggggttacgggtaacgggtaaaccgttaacccggtaaaaacggtaaccgggttacgggttacggtaccggtttaccggaacccgttaacccgttacgttacccgggtttacgtttaacccg

SEQ ID NO: 147370 - DNA, 906 bp, Homo sapiens
  misc_feature: GYAE6OF02GPTVV.3.23.C01.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccagatacccccggagaaattcttttgacgcagtctccaggcaccctgtctttgtctccgagggatagngccacctntcctgcaggccagtccgagtgtcagcagcaaccacgttagcctggtaccagctagacgacctggccaaggtcctacccgaggccttaccgtctaactcccgtaagtcgggtcgaccgtaacgtacccgaaacggtaccgggaccctaacggttcggaccctaacggttacccccgtaaacgggtaaccgttacggggtttaccaacgggttcggtaccgttaacgggttcggggtttaccgtacggggtaaacctacggttaccgtttaccgtaccgttacccgtaccgtaaacccgtacgttacccggtaaaccggtaccgtaaccgggtaaacccgttcgggtaacccggttaacccccggttaggtaaaccgggtttacccggtttaccggaacggttttaacgggtttttaaaccgttacccggttttacggtttaaccgggttacgtaaccggtttaaggtttaaccgttcggggttttaacccttaccgggtttaccgtttacggttttacccgggttaaccgtttaaccggtttccgggtaaccgggtaccggggttaaaccgttaacgggggtttaccggtaaacgggttaaccgtttaaacccggtaaaacgggttaccgttagggtaaccggttacgtaccggtaaacccgttacgttacggtttacccgttaggtttaacccccgg

SEQ ID NO: 147371 - DNA, 583 bp, Homo sapiens
  misc_feature: GYAE6OF02IA222.3.23.C01.1.454.CMB.1.raw
  modified_base (339)..(339): a, c, t, g, unknown or other
  misc_feature (339)..(339): n is a, c, g, or t
  modified_base (577)..(578): a, c, t, g, unknown or other
  misc_feature (577)..(578): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacacacggccgtgtattattgtgcgaggacaatctgtgccggtgactgctacgtcgatttcgngggaccacgggtacctggtccaccgtctcctcacgccctccaccgaaggcccctagtccggtccttcccccgtcggcccacccctcctcccaacgacgactacccgtcgtcggggaccacgacgccggcccgtcgggcgtcggtccgtcggtcgaacggtaccgtaccgtttaccgcgtcgtaccgttcgttcgtacggacggtcgggcgtacgggcgaacggtccgacgacgtacgnngncnn

SEQ ID NO: 147372 - DNA, 631 bp, Homo sapiens
  misc_feature: GYAE6OF02IEM1F.3.23.C01.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
tcagagacgcactccacgaccggtgctcgatttagtacacgtgattagggattggggcctcagtgaaggtctcctgcaaggcgtctggatacgacgtcagcaggatgtatatacactgggtgcgacaggccctggacaaggccttgagtggatgggaataatcaacctagtgatggtggcacaagctacgcaaaccagttccagggcagagtcacatgtacaagggacacggccgcgaacactagtctatttggaactgaagaatttagaaattcngacgacacggcgtgtattatgtagcgagacatctgngcggtnatgctcgtgtactttcgcggcaacgggaccctggtacctccggttctcctcgacgtccctacaaccgaacgggcccctaagtccggttcccttccccggtacggtccctaccccgtccctacctaacgacgaccgtaccgtccggtcgggggaccaccgaccggtccgggtcccgtcggggtccgtaccggtcccgtacggttaccgaagggttacccttacgtaccgtacggttcgtaccgttaccgtcgttacggacgggtcgggtacgtcgggaccggaacggcggtaccacggtacggacncgtcngcg

SEQ ID NO: 147373 - DNA, 572 bp, Homo sapiens
  misc_feature: GYAE6OF02G5FFM.3.23.C01.1.454.CMB.1.raw
  modified_base (431)..(431): a, c, t, g, unknown or other
  misc_feature (431)..(431): n is a, c, g, or t
  modified_base (566)..(566): a, c, t, g, unknown or other
  misc_feature (566)..(566): n is a, c, g, or t
  modified_base (570)..(572): a, c, t, g, unknown or other
  misc_feature (570)..(572): n is a, c, g, or t
tcagagacgcactccacgaccggtgctcgatttagtacacgtgattagggagttggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaaggacacggccgcgaacacagtctatttggaacttcgaagaatttgaaaatctgacgacacggccgtagtattattcgtagcgaggacaatctgtgccgtgactgctacgtcgatttctgggccagggaaccctggtcaccgtcacctcagcctccacaaacgggcccaagtccgtcttcccctggccacccctccctccaacgacnccaccctcgtcgggggccacgacgccggcccgtcgggcctcgccctcggttccgaaaggtccttaaccgttccgaacgtcgcggtccttaccgtcgacgtccggggacgtggccgaacggcgacgtacgtacgangcgnnn

SEQ ID NO: 147374 - DNA, 648 bp, Homo sapiens
  misc_feature: GYAE6OF02GO8YC.3.23.C01.1.454.CMB.1.raw
  modified_base (313)..(313): a, c, t, g, unknown or other
  misc_feature (313)..(313): n is a, c, g, or t
tcagagacgcactccacgaccggtgctcgatttagtacacgtgattagggattggggagagctgctcagttaggacccagagggaaccatggaaaccccagcgcagcttctcttcctcctagctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctccaggctcctcatccatggtgctagtcccaanacgggccacgtggcactcccgagaccacggttcacggtgacgtaggtcggggtactggaaacacggtaccttcgaacctctaccgacctagtaccagaccaaggtcgtagggtacgcccttaggaaacgttacctttcggtacttaggttttaacttacttacggttacctggtactaaggttagttaccgggttaactttccgtactttcgtttagggttaccttaaacggtttcgggaccggtaccggggtaactacgggttacggacgaacgttaaccgaaacggtacgttaggtggtacctaggtccctaccgagttccgttagttacccg

SEQ ID NO: 147375 - DNA, 706 bp, Homo sapiens
  misc_feature: GYAE6OF02JZ44Q.3.23.C01.1.454.CMB.1.raw
  modified_base (198)..(198): a, c, t, g, unknown or other
  misc_feature (198)..(198): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggganagagccaccctctcctgcagggccagtccgagtcgtcagcagcaaccacttagcctggtaccagcctaggacgacctggccaggctccaggctcctacatcccagtcgggtcacctacgtcccaaacgcggggtcccaacgttcgggaccaccgttaccccgaaggtaaccgtacgggtttaccaaggttccgggaccgtaagggttcggggtacctagggaaaccgtacggtacctttaccacgttaccttaccgaaccctatacccgtaacgccgtaacgacgttacgggacgtcccgtaagtaaacgttaccgtttacgaccgttaagttttaactaccgttcggtaccgttagtaccgtaaggttacgttacgttaaccgttcgtaaccgttcgtttaacgggttactaaacggttttccgggaccggtacggtaacgtagggtagacgtacgtaccgaaacgtaacgtcggtacgcgtacgaccgtactacgtcgttgttacc

SEQ ID NO: 147376 - DNA, 644 bp, Homo sapiens
  misc_feature: GYAE6OF02HB7RM.3.23.C01.1.454.CMB.1.raw
  modified_base (638)..(638): a, c, t, g, unknown or other
  misc_feature (638)..(638): n is a, c, g, or t
  modified_base (644)..(644): a, c, t, g, unknown or other
  misc_feature (644)..(644): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcacatgtcaagggacacggccgcgaacacagtctagttggaactgaagtaatttagaaatctgacgacacggccgtgtattagttgtgcgaggacaatctggtcgccggtgactgctacgtcagttccgtgggccagggacctggtcaccgtctcctcgacgtcctccaacctacgggcccctagttccggtcccgttccccccgtacggccctacccccgttccctacccgaacggtacgacccgtacccgtccgtacgggggcctacggaccggtacccggcccggtcgggccgttaccggccgtacgggtaccgtaacggtaaccgttaccgttccggtacggtcgaccggttccttaccggtcgtacgggtcccgggcgttacgggacgtaacgggccgtacgtacgtacgtcgagtacgngtacgn

SEQ ID NO: 147377 - DNA, 553 bp, Homo sapiens
  misc_feature: GYAE6OF02HC44U.3.23.C01.1.454.CMB.1.raw
  modified_base (339)..(339): a, c, t, g, unknown or other
  misc_feature (339)..(339): n is a, c, g, or t
  modified_base (548)..(552): a, c, t, g, unknown or other
  misc_feature (548)..(552): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcnggggccagggaccctgggtcaccgtctcctcacgtcctccaccagggcccagtcccggtccttccccctcggccaccctccctcccaagacgccaccctcgtcggggccacgacggccggcccgtcgggcctcgccgtggtccgaacgggtactacgttccgagtcgcgtctcgtgacggcgggcgtcggcgacggccgcgtacgagcnnnnng

SEQ ID NO: 147378 - DNA, 742 bp, Homo sapiens
  misc_feature: GYAE6OF02FHPGQ.3.23.C01.1.454.CMB.1.raw
  modified_base (739)..(741): a, c, t, g, unknown or other
  misc_feature (739)..(741): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggcccctggacaaggccttgagtggaatggaaataactccaacccgtagtgatggtcggacaacaagcctaacggaccaaaccgtcgttccagggcagaacgtccaccacgttcgaccgaacgggacccgaccggacccgtacgaaccgtaccgacggttaccgttaagtttacgggaactagtaaacgtaacttttcgaaacgtcgtacgaaccggaccgtccgggttactaggttacttacttcggtacgacgtaaggaacctagttcgtcggtccgtcgtcgaactgtaccgttaccgtcgtaacgttccgggacggacccgacgtacccgtcgtcccgtaccgtccctaccgcgaccgtccccttaaccggaacccgacccggtccctaccgttccccggtacccttccccggcgtacccctacccctaccgtaccgaacgtaccgacccgtccgtaccgggccgggcctaccgggccgtcccggacgttccgccgttacggtcccgttacggtaaccgtaaccgttaccgttagttcccgaagtccggtaccgtccgtacggtcgacggtccggtacgacggaaccgacgtcagagtcacgctacnnnc

SEQ ID NO: 147379 - DNA, 682 bp, Homo sapiens
  misc_feature: GYAE6OF02IB25B.3.23.C01.1.454.CMB.1.raw
  modified_base (301)..(301): a, c, t, g, unknown or other
  misc_feature (301)..(301): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgacaaacagttccagggcagagtcacatgcaaggacacggccgacgaacacagtctattaggaactgaagtaactttgaaatctagacgacacggcctgtaattagttgngtacgaaggactaatcgtagtacgccggtgactgactaggtctagttcgtcgggaccacgggtaacccttggccaacccgtttctcctacgacgtaccctacccgaaaccgacgggtcccaagttcccggttcccttacccccgtcggaccgtaccccctacctacccgtaaacgacgtaccctaccgtaccggtcgggaccaccgacgcccgggtccgtcggggcctcggtacccgttacgggtaccgtaaaaccgggtacctttaacccgttaccggtaacgttacggtcccgttacgttaccggtacggaacggccggggtaccggtcggtaacggaaccgggccgttacgaacggttacggacgtagcggagtgacg

SEQ ID NO: 147380 - DNA, 660 bp, Homo sapiens
  misc_feature: GYAE6OF02H8CMV.3.23.C01.1.454.CMB.1.raw
  modified_base (376)..(376): a, c, t, g, unknown or other
  misc_feature (376)..(376): n is a, c, g, or t
  modified_base (653)..(653): a, c, t, g, unknown or other
  misc_feature (653)..(653): n is a, c, g, or t
  modified_base (658)..(658): a, c, t, g, unknown or other
  misc_feature (658)..(658): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccagggcagagtcaccatgtcaagggacacggccgcgaacacagtctatttggaactgaagaatttagaaatctagacgacacggaccgtgtattattgtgcgaggacaatactgtagccggtgtactgctacgtcgatttcgtgggccgagggaacctggtcaccgtctcctcncgcctccacccgaacggcccaacgttccggttaccctttccccccgtcgggtacccctaccccgttccctacccgaaacgtacgaccccgtaccttccgggtcgggggacctaacgacggcccgggtcccgtcggggacctcgggtcccgttagggtaccgtaaacgggtacccttaacccggtttaccgaacggttcggtaccgttccgttcgtacggtcggccggggtcggtacgggaccgtaacggggtacccgaacgttacgtaaggcgtacncacgncg

SEQ ID NO: 147381 - DNA, 705 bp, Homo sapiens
  misc_feature: GYAE6OF02H3JRJ.3.23.C01.1.454.CMB.1.raw
  modified_base (259)..(259): a, c, t, g, unknown or other
  misc_feature (259)..(259): n is a, c, g, or t
tcagagacgcactccacgaccggtgctcgatttagtacacgtgattagggattgggggagagctgctcagttaggacccagagggaaccatggaaaccccagcgcagcttctcttcctcctgctactctggctccagactacccccggagaaattcttttgacgcagtctccaggcaccctgttctttcgtctccgagggggagagacgcccaccctcctccgtgcacgggccaggtccgagtcgtcagcagacaaccnttacgccgtcggtaccagcagaggacctggccaggcctccgaggctcctcactccagtcggtcactaactccgaaaccgacgggccctagtacggccaacttccccgaagaccgtaggttccgaggtacggactaagggttcgggttcgacggtaaccaaggtacctttacgaaccgttccacctacccagttaccgagaccgtaggtaccgtacggacgtccgtacgtaacgtacgttcgtaacgttaagtttacgtttacgttcgttacgttcgtacgtagttacgttaggtttaccttacgtacgttcgttaggttacttacggtttcggtaccggtaccgggtaacggtacgggtacgggtacggtaacgtaacggtaaacggtaacggttacggtacggacgttttccggaccgtaaccgtcgttaccgttagtttacccg

SEQ ID NO: 147382 - DNA, 548 bp, Homo sapiens
  misc_feature: GYAE6OF02JDI9N.3.23.C01.1.454.CMB.1.raw
  modified_base (344)..(344): a, c, t, g, unknown or other
  misc_feature (344)..(344): n is a, c, g, or t
  modified_base (419)..(419): a, c, t, g, unknown or other
  misc_feature (419)..(419): n is a, c, g, or t
  modified_base (498)..(498): a, c, t, g, unknown or other
  misc_feature (498)..(498): n is a, c, g, or t
  modified_base (543)..(547): a, c, t, g, unknown or other
  misc_feature (543)..(547): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgacgaacacagtctatttggaactgaagaatttgaaatctgacgacacggccgtgtattattgtgcgaggacaatcgtgtggccggtgactgctacgtcgtatttcgnggggccagggaccctggtccaccgtctcctcacgccctaccaccgaacggcccagtccgtccttccccgtcgccncccctcctaccaacgacgccacccgtcgtcgggcacgacgccggcccgtggcctcgccgtgtcgaggtcctacgtccgngtcgcgtctcgtgcggcgggtcgtcggacgacggcgacgagtcgnnnnnc

SEQ ID NO: 147383 - DNA, 580 bp, Homo sapiens
  misc_feature: GYAE6OF02G1M48.3.23.C01.1.454.CMB.1.raw
  modified_base (340)..(340): a, c, t, g, unknown or other
  misc_feature (340)..(340): n is a, c, g, or t
  modified_base (576)..(578): a, c, t, g, unknown or other
  misc_feature (576)..(578): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttcgnggggccaggggaaccctggtccaccgtctcctcagcctccaccaaggcccatccgtccttccccgtggccacccctcctccaacgacgccaccctcgtcggggtccacgacgccggcccgtcgggcctcgcccgtgggtaccgaaacggtacctaaccgtttcccggaagtcggtccgttccgtcgtcggacggccgggtcgtcgggaccgaacgggccgaccgagtaacggcacnnngc

SEQ ID NO: 147384 - DNA, 884 bp, Homo sapiens
  misc_feature: GYAE6OF02IK0O4.3.23.C01.1.454.CMB.1.raw
  modified_base (252)..(252): a, c, t, g, unknown or other
  misc_feature (252)..(252): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggccaccctgtctttgtctccgaggggagagacgccaccctctcctgcacgggccagtccgagtgtcagcagccaaccncttagcctggaccagcagacgacctggccaggcctaccgacggtcctccctacgactcctagtcgggtcgacctaactacccgaaacgacggggtaccctacggtccgggtaccaccgttacccccgaaggtaacccgttacggggttccgtaacgggtttaccgggaaccggttacgggggtttccggggtaaccgtttaaccgggggaaaacgtaacgggttaacctttaacccgtaacccttacccgttaaacccgaaaccctattaccccgaacggtaccgtaaaccgtaacgtaacgggaccgtaccggttaacgggaaaccgttaaccggttttacggtaccgttaaggtttttaacgtttacgttaccggtttccttaacggtaccgttaacggttttaccgttacgggtttaacccttttaccggtttaacccgttttaccggtttacggtttaacccgtttaaacggggttttacccggggaacccggggttaaccccggggttaaacgggtacgggggttaacgggtaaaccggtaaacgttaaaccggaaaccggttaacgttcggggtacccggtacggttaccgaccgttaaccgtacgtttccggtacgtttaccccg

SEQ ID NO: 147385 - DNA, 595 bp, Homo sapiens
  misc_feature: GYAE6OF02IQ1ER.3.23.C01.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccngttccagggcagagtcaccatgtcaagggacacggccgacgaacacagtctatttggaactgaagaatttgaaaatctagacgacacggccgtgtattattgngcgaggacaatctgtgccggtgactgctacgtcgatttcgnggggccagggaccctggaccncgttcnctcagccctaccaccgacgggcccagttccggtccttccccgnggccctaccccgtcccaccgaacgacgcctaccgtcggtcggggaccacgacggccggtcccgtgggcctcggtcccgtacggtccgaaacggtaccgttacgtttccggacgttgccgttactccggtagacgggtccggtcggtacggcgaacggccgacgtacgtaggcngtcagntcg

SEQ ID NO: 147386 - DNA, 669 bp, Homo sapiens
  misc_feature: GYAE6OF02I3HMM.3.23.C01.1.454.CMB.1.raw
  modified_base (198)..(198): a, c, t, g, unknown or other
  misc_feature (198)..(198): n is a, c, g, or t
  modified_base (662)..(662): a, c, t, g, unknown or other
  misc_feature (662)..(662): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccagcaccctgtctttgtctcagggganagacgccacctctcctgcagggccagtccgagtcgtcagcagccaaccacttacgccgtggtaccagcaagacgacctggccaggcctcccgaggcctcctcgactccagtggtacgctactccgaacgtacgggccacgtcggacactcccagacgtagttccagtcgcgtaggtcggtctaggaactacggtaccttcgaccgttactccgaaccttacgacacggtaccgtaacggacggtacggtacgtacccgttaagaaacgttccgtttacggaccttaaggtttttaactacgttcgtacgttacgtactaaggttacgtttacggtaacctttcgtaacgtttcgttaacgggtcttaacgggttcgggacgggtaccggaacgttaggggtcgtaacgtacgtaaacctaaacggtacgttgtaccggtctacggccttaacctgttaccggtntttaccg

SEQ ID NO: 147387 - DNA, 882 bp, Homo sapiens
  misc_feature: GYAE6OF02HMEBJ.3.23.C01.1.454.CMB.1.raw
tcagagacgcactccacgaccggtgctcgatttagtacacgtgattagggattgggggagagctgctcagttaggacccagagggaaccatggaaaccccagcgcagtcttctcttcctcctgctactcgtgcctccagaccgtaccccggaagtaaactttcgtttagacgtcgtagtcctaccgacggacctacccgttgttccgtttcgtcccgtaccggaaggggtagacggaccgaccctacccttccgtccgtcgaccggacgggcctacggtaccggtaggttcgtacgacgtacgacgaaccaaccgttaacgtttaccggccgttacggtaacccgagacgaacggacgtaccgtacggaccgacggtaccctacccgacggtcctacctactacgtccaggtcggtacactaccgtaccgaaccggccggaccacgcggtaccacctaccgaggtacgtacggtacgacggtcggaggtacgggtcggtacgtaacggactacgtaccttccgtacctcctaacctactacgtacgaacgtacgtacgtaccgtaacggaccgttaccggtaaggtaacgtttacggttacgtaacgttttaacgtttaacgtttcgttaccggttacgttaccgtaacgttaacgtttacgtttaacccggttaccctttaacggtttaccgttttaccgggtttaacggttaaaccgtttacggggtcccgggtaacggggtaacccgggttacgggtacggggttaacgttaaaccgggtaaaccggttaaaccgggtaaacggttccggttacggggtaaccgtccggttaaccctaaccggtttaaccgttacgtttccgtttaacccggttaaccc

SEQ ID NO: 147388 - DNA, 637 bp, Homo sapiens
  misc_feature: GYAE6OF02JF3M0.3.23.C01.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaaccctagtgatggtggcacaaagctaacgcaaaccngttccagggcagaagtcaccatgacaagggacacggccgngaacaacgngtactatttggaactgaagaattgaaatctgacgacacggcgtgtatnttgtgcggaggacaatcgngtgccggtagactgacctagtcgtatttcgtggggaccacggaaacccgtggtaccaccgtctacctacgacgtccctccgaaccgaaacgggccccaagttccggtaccgtttccccccgtacgggtccaaccccgttccctaacccaacgacggacgtacccgtacggtcggggccaacgacgccggtcccgtacgggtccgtcgtccgtaggttaccgaaacggtacctaacgttcccgtaacggtcgaccggttcgtacgtcgaacggcggggtacgtcgggactaacgggccgacgtaacgacggtcgncncnng

SEQ ID NO: 147389 - DNA, 734 bp, Homo sapiens
  misc_feature: GYAE6OF02G58MD.3.23.C01.1.454.CMB.1.raw
  modified_base (284)..(284): a, c, t, g, unknown or other
  misc_feature (284)..(284): n is a, c, g, or t
  modified_base (705)..(705): a, c, t, g, unknown or other
  misc_feature (705)..(705): n is a, c, g, or t
tcagagacgcactccacgaccggtgctcgatttagtacacgtgattagggattggggagagctgctcagttaggacccagagggaaccatggaaaaccccagcgcagcttctcttcctcctgctactctggcctcccagactacccccggagaaattcttttgacgctagtctccaggccaccctgtctttgtctccgaggggtagagtacgccctacccgttctccgtggacacgggccagtccgagtcgtcagcgagccaaccacttagccctaggtacccngaccacgacgacctcggccgaggtccctaccccgaggcccttccctacgtacgtcccgtaggttccgggtccgaccgtaaccgtaacccgaaaccggaccggggtaccctaccggtacgggcctaaccgtcccccgagtaccgtacggttcacggtcggacgtagggttcgggtctaagggacctagtaccgttacacccttccacaccctagtccgacgtaccgacggtacggtacggtaccggtaccgttacggtaaacggttccgtttaacgaacgtttaagttttaacgttcgttacgttccgtacgtaccgtagtttacgttcgtttaaccttcgttaccttcgttacgttacgttcggttccggacggaccgggtaacgtagggtgaacgtcgtaacgtaacgtacgttgggtanccggttacgacctacgtacttgtcgttac

SEQ ID NO: 147390 - DNA, 335 bp, Homo sapiens
  misc_feature: GYAE6OF02HB1U9.3.23.C01.1.454.CMB.1.raw
  modified_base (321)..(335): a, c, t, g, unknown or other
  misc_feature (321)..(335): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagagcccaccctctcctagcgacgggccaggtcgagtgtcagcagacaacctacgttagccgtaggtaccagcagacgtactggccaggcctacccgaggtcctacctcactcagtggtcnnnnnnnnnnnnnnn

SEQ ID NO: 147391 - DNA, 694 bp, Homo sapiens
  misc_feature: GYAE6OF02IM2GS.3.23.C01.1.454.CMB.1.raw
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (688)..(688): a, c, t, g, unknown or other
  misc_feature (688)..(688): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaaccctagtgatggtggcacaagctacgcaaaccagttccagggcagagtcaccatgtacaagggcacggcgcgaacacagtctattggaactgaagtaatttagaaatctagacgacacggccgtgtattattgtgacgtagacatctggtgccggtnactgctacgtcgtatttcgngggccagggtaaccctggtacctaccgtcgtcctcgacgtccctaccacccggtaggcccctagtccggttcccttcccccgtgggacccctaccccgtcccttaccgaaacggtaccgcccgttaacccgtcggtcggggacccaacggtccggacccgggtcccgttagggccctaccggtcccgttacgggtacccgtaaacggggtaccctttacccggttacccgggtaggttccggtacccgttacgttccggtacgggcgggtacccgggggtaccttcggggaacccgtaacggggaccgttacccgtaacggttaacgggctaaccggtcgtacgngtacgg

SEQ ID NO: 147392 - DNA, 631 bp, Homo sapiens
  misc_feature: GYAE6OF02IITDO.3.23.C01.1.454.CMB.1.raw
  modified_base (343)..(343): a, c, t, g, unknown or other
  misc_feature (343)..(343): n is a, c, g, or t
  modified_base (627)..(627): a, c, t, g, unknown or other
  misc_feature (627)..(627): n is a, c, g, or t
  modified_base (630)..(631): a, c, t, g, unknown or other
  misc_feature (630)..(631): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgacaaaccagttccgagggcagagtcaccatgtacaagggcacggccgacgaacacagtctattggaactgaagaatttgaaaatctgacgacacggccgtgtattattgtgcgaggacaatctggtgccggtgactgctacgtctatttcnggggccacgggaaccttggtaccgacccgtctccctcacggccctaccgaaccgaacgggcccctaagtccgggttaccctttccccccgtgggtccccgtccccttcggcccgttccgaacgggaccgcccgtaacccgttacccgaggaacgtccaaccgacggcccggacccgtggggccctcggtcccgtgggtaccaaacgggtccctaacgttccggacgttcgccgttcctcgtacggacgggccgggcgtcggacgaacgggcgactaagtggacngtnn

SEQ ID NO: 147393 - DNA, 723 bp, Homo sapiens
  misc_feature: GYAE6OF02IZ3C6.3.23.C01.1.454.CMB.1.raw
  modified_base (717)..(717): a, c, t, g, unknown or other
  misc_feature (717)..(717): n is a, c, g, or t
  modified_base (719)..(719): a, c, t, g, unknown or other
  misc_feature (719)..(719): n is a, c, g, or t
tcagagacgcactccacgaccggtgctcgatttagtacacgtgatttgggagttgggcctcagtcgaaggtctcctgcaaggcgtctggatacgacgtcagcaggaggtagtatacactgggtgcgacaggccctggacaaggccttagagtggatgggaataatacaaccttagtagatgggtgcacaagctacgacaaaccacgttccagggcagagtccaaccagtagtcaagggacacggccggacgaacacgaggttactagtttagggaactggtaagtaatttagaaatcgtagacgacgacggtccgtaggttactttagttgtggcggaggaacaatcgtggtacggccggtacgtccgtgtacgtacgtacgttatttaccggtggggaccacggggaacccgtttcggtacccgtaccgttcccgtccgttaccacggtcccacccgtaccgaaccggggtcccaacgttccggtacccgtttccccgtacggtacccctacccccgtaccttaccgaaccgtaccgacctacccgtacggtccgggaaccgtcggtaacggtcccggccgtacggtccgtcggtcccgtaggtacgtaaccggtacgttaaccgttccggtaacgtcggtccgttacgtccgttacggaccggtccggggttagtccgggtaaccgtacgggaccacgtacgtcgagtcgtacgngntacg

SEQ ID NO: 147394 - DNA, 632 bp, Homo sapiens
  misc_feature: GYAE6OF02GYCLC.3.23.C01.1.454.CMB.1.raw
  modified_base (626)..(627): a, c, t, g, unknown or other
  misc_feature (626)..(627): n is a, c, g, or t
  modified_base (630)..(632): a, c, t, g, unknown or other
  misc_feature (630)..(632): n is a, c, g, or t
tcagagacgcactccacgaccggtgctcgatttagtacacgtgattagggattgggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcgaagggacacggccgacgaacacagtctatttggaactgaagtaattagaaatctgacgacgacggcgtgtattattgtgcgaggacaatcgtgtgccgtgactcgctacgtcgtagtttcggtcggggccgacgggtacccgtgggtcccaccgttcctcctacacgtccctacccgaccggaaccggccctacgtcccggttcccttcccccgtcggtcccctacccctccctaccgaaacgccgacccgtaaccgtccggtcggggtaccaccggacccggccggtcccgtcgggtcctcggtcccgtacggtacgaacggtacgttaccgttccgtacggtcgtccgttctcggtgacgggccgggtcgtccgggacgaccggccgtagacgtacggnngcnnn

SEQ ID NO: 147395 - DNA, 758 bp, Homo sapiens
  misc_feature: GYAE6OF02FXM4X.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccgaggggagagagccaccctctcctgcgacgggccagtccgagtgtcagcagccaaccacttagccgtggtacccagcagacgacctggccaggcctcccgaggctcctacactccagtggtgacctatcccgaaacggtacgggacccaacgtcgggaccaccgtacccccgaaggtaaccgtacgggtttaccaacgggttacgggaccgtaacgggttcgggggttaccgtttaaggggaaaaccgttaggtaaccccgtttaccgtaacccgtttacccgtaaccctaaacccgtacttaccgaacgaccgtaacggtaaccggtacgggacgtacccgttaagtaacgttacgtttacgaccgtttaagttttaacgttaccgttcgttaccgtagtaccgtaaggttaagttacgggttaacctttccgtaacgtttccgtttacggttaacgttaacggtttcccgggacgggtaccggtaaccggtagggttacggaacgtacgtaaccgtaacgggtaccttaggtgactacggtaccgacctagttcctcggttacc

SEQ ID NO: 147396 - DNA, 654 bp, Homo sapiens
  misc_feature: GYAE6OF02I1M17.3.23.C01.1.454.CMB.1.raw
  modified_base (195)..(195): a, c, t, g, unknown or other
  misc_feature (195)..(195): n is a, c, g, or t
  modified_base (210)..(210): a, c, t, g, unknown or other
  misc_feature (210)..(210): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (530)..(530): a, c, t, g, unknown or other
  misc_feature (530)..(530): n is a, c, g, or t
tcagagacgcactccacgaccggtgctcgatttagtacacgtgattagggagttggggagagctgctcagttaggaccagagggaaccatggaaacccagcgcagcttctcttctcctgctactctggctaccagactaccccggataaacttctttgacgcagtctccaggcacctgtcttgtctacgaggganagcgccacctctcgngcgacggcctagtccgagtcgtacgagcagacaaacncttagccgtagaccngcagacgactgacgcgctaccgaggctcgtcaagttccaagttcggacnctactaccgaacggacggctaacgtggaccaatcccgaagtaccgtagtcagtcgactacgggttggtaccgtggaactaaggtctaaccncgttaccncgactagtcaggtcacgtcctgacgtagtacgagtaaggttacttccggacttaaccttttgttacgtaggacctaggtaactaacgtaacggttaaacttacgtccgactttaccgggngtttaaccggaccgggttaaccggaacgttagggacgtaacggtaactaccggtaaaacgttaaggcgttaacggttagacccgtacgtaccaacccggtttggtaacggtttcccttaacggg

SEQ ID NO: 147397 - DNA, 612 bp, Homo sapiens
  misc_feature: GYAE6OF02H5GSD.3.23.C01.1.454.CMB.1.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccagatacccccggagaaatttcttttgacgcagtctccaggcaccctgtctttgtcctccgaggggagagacgccaccctctcctgcacgggccaggtccgagtcgtcagcagaccaaccattacgcctacggtaccagccagacgaccgtcggccaggcctcccgaggcctaccgtcatcgattggngcatccaanggccngtaggcanccagaccgtaggtcagtcggactggttcgggactagggaacaggtaccttacgacttcctacaccctagtccgaagtcaacggtacgtcggacgtacgtaggaactcgttcgtacttaagtttacttacgtgtactcgtatacgttagtcgtacttacgactttcgttcggtactacggttcgggacggcggttaccgaggggttacgacgtacggtacgaacggttaacgtgggtacgtactcggacctaacgtgttaccctgttacg

SEQ ID NO: 147398 - DNA, 788 bp, Homo sapiens
  misc_feature: GYAE6OF02HEK8B.3.23.C01.1.454.CMB.1.raw
  modified_base (201)..(201): a, c, t, g, unknown or other
  misc_feature (201)..(201): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggcaccctgtctttgtctccgagggganagagccaccctctcctgcagggccagtccgagtgtcagcagcaaccacttagcctggtaccagcagacgacctggccaggcctaccccgaggcctcctcactccagtggtcgactactacccaacgacgggccacgtcggccactcccaggaccgtaggttcaacggtcgaccgtaggtgggtactaggaacgtaggtcctttacgaaccgttcctaccgaaccctagtcccgaacggtacctaacgggtaaccgttacggggtaaacggcccgttaaagggtaaaccgtttaccgtttacggaacccgttttaaggtttttaaccttacggtttacgttaccgttaggtaaccgttaaaggtttacttaccgggtttaacctttaccgttaccgtttacggttttacggttaaccgtttaaacgggttttcccggggaaccgggttaaccgggttaacccgggtaacggggttacgggttaaaccgggttaacgtaaacccgggtaaaacggttaaccggttagggttaaccggtaccgttacgggtaacccctaaccgttaacggtttcccttagggtttacccc

SEQ ID NO: 147399 - DNA, 732 bp, Homo sapiens
  misc_feature: GYAE6OF02HSAX2.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctcccagactacccccggagaaatttcttttgacgcagtctccaggcaccctgtctttgtctccgaggggagagacgcccaccctctcctgccgacgggcctagtccgagtcgtacgagcgagaccaaccgtattacgcctacggtaccagcaagacgacctggaccgaggcctcccgagtcctcctcactccgagtcggtcacacgtaccgaacgacgggcccacgtcggacctaccgtacccgaaggtaccgtaggttacgacggtcgggaccgtagggttccgggtacgtacgggaaaactacggttacctacgtacctccgtaccaaactcgtacgacgccgaacgtacggtggaccgtacgtaaggtaacgttactttaggaactttagtttaccgttagttcgttacgtacgtacgtagtttacgttacggttacctttaccgtaccgtttacgttacggttaaccgttaacgggtttccgggaaccggggttaccggtaccggtaaggggttccggaacgtaacggttaaccggtaaacggtacgttcgggtaccgtaccgtcggtacctaaccggttacttcggttaccttac

SEQ ID NO: 147400 - DNA, 603 bp, Homo sapiens
  misc_feature: GYAE6OF02ILI5W.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcactccagtcggtgcatacccaaacgacggggcccaacgtgggaccacgtaccccgaaggacctagggttcaggttcgggactagggtcggggtctaggaacagtacttacactctaccaacctatcagcaacgacgtggacgtcgtagaagtctttagacttagtttattacgtgttctgtacgtagttattaggtactttcgtacttcgttacgtacttacggtttcgggcggtaccgggacgtagggtaggacgtaataaccgaaacggtacgtacggtaggtctacgtacgaccgtagtctagttcc

SEQ ID NO: 147401 - DNA, 718 bp, Homo sapiens
  misc_feature: GYAE6OF02HDTYE.3.23.C01.1.454.CMB.1.raw
  modified_base (545)..(545): a, c, t, g, unknown or other
  misc_feature (545)..(545): n is a, c, g, or t
  modified_base (713)..(713): a, c, t, g, unknown or other
  misc_feature (713)..(713): n is a, c, g, or t
  modified_base (716)..(716): a, c, t, g, unknown or other
  misc_feature (716)..(716): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggcccctggacaaggccttgagtggatagggaataatcaaccctagtgatggtgcacaagctacgacaaacctgttccgagggcagacgtcacatgtacgaacgggacgacggccgacgaacacagtctagttggaactagaaagtaatttagaaacttcgtaggaacgaaccgtaccgggtccgttagttaactttaagttggtacggaccggaacggtaactaaacgttcgtggtcggtccgggtagacgttcgcgttacgtcggttacgtttcggcggggaccctaacggggtaacccgttggtaccctaccgttcccgtcctacgtaccgtcccctaccgaacccggaccgggtccctacgttcccggttccccgttccccgtcgtacccctacccctccctaaccgacgacncccgtaccgtcggccgggccaccgccggccggtcccgtcgggcctccggtcgttcggtaccgtaacggtacccgttaccgttaccggtacggtccgtccgtttcgtccggtagggtaccgggaccgggtccggtaccgggacgaaccgggtccgtacgagtacgcagngcngc

SEQ ID NO: 147402 - DNA, 933 bp, Homo sapiens
  misc_feature: GYAE6OF02IMKY4.3.23.C01.1.454.CMB.1.raw
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaacctagtgatggtggcacaagctacgacaaaccagttccagggcagagtacaccatgtacgaagggacacggccgcgaacactagtacttagttacggaacttgaaagtaattttagaaaacttcgtacgaaccgaacgacccgggtaccgttagttaactttaagttggttaggcgggtaaacgggtaaaccttaaagttaccgttacgggttaccgggtaccgggtttacggtaacttacggtacccgtttaacggtaccggttacgtttttaccgggtacgggggtaccccggtaaacgggggtaaccccgttcgggttacccgtaacccggtttcccgttacccgttacccgtacgggtaccccccttacccggtaaaccccggtaaacccggggggtacccccttaacggtttacccccggggtttaccccgtttaccccccccggttaggggtcccccccttaaccccgttaccccgtaacccgttaaaccggaccgtacccgttaaccccggtccgggttaccggggggaccctaaacggtacccggggtaccccggtaccccgggttcggggcccgttaccgggttcccggttaccgggttaacccgtaaacgggttacccgtttaaccgttacccgggttacggttacggttacccgttaccgttccggtacgggtaccgggtcccggggaacgtttccgggaaccggtaaccggggtcgtaacccgtaaggttaacgtccgaagtcgtaggtacacgg

SEQ ID NO: 147403 - DNA, 624 bp, Homo sapiens
  misc_feature: GYAE6OF02IDTW5.3.23.C01.1.454.CMB.1.raw
  modified_base (298)..(298): a, c, t, g, unknown or other
  misc_feature (298)..(298): n is a, c, g, or t
  modified_base (618)..(618): a, c, t, g, unknown or other
  misc_feature (618)..(618): n is a, c, g, or t
  modified_base (621)..(622): a, c, t, g, unknown or other
  misc_feature (621)..(622): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatggggaataatcaaccctagtgatggtggcacaagctacgcaaaccagttccagggcagagtcaccatgtcaagggcacggccgcgaacacagtctattggaactgaagaatttgaaatctagacgacacggccgtgtatattgngcgaggaacatcgtgtcggccggtgactgctacgtcgtgttcgtggggccagggtacccgtggtccaccggtctccgtcgacgccctaccaccgaacggccctacgttcccggttacccttcccccgtacggcccctaccccgtaccctacccgaagaccggaccctacccggtcgggtcgggtaccgaccgacggcccggcccggtcgggtccgtcggcccgttagggtacccgtaacgggtaccttaccggttaccggtacggtccggtaccgttcgtccgtgccggcggtcggtcgggacgacggccgagacgtcgncgnngc

SEQ ID NO: 147404 - DNA, 782 bp, Homo sapiens
  misc_feature: GYAE6OF02H0XV9.3.23.C01.1.454.CMB.1.raw
  modified_base (323)..(323): a, c, t, g, unknown or other
  misc_feature (323)..(323): n is a, c, g, or t
  modified_base (757)..(757): a, c, t, g, unknown or other
  misc_feature (757)..(757): n is a, c, g, or t
  modified_base (776)..(776): a, c, t, g, unknown or other
  misc_feature (776)..(776): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacgaggcccctggacaaggccttgagtggatgggaatatcaaccctagtgatggtggcacgaagctacgacaaacgagttccgagggcagacgtcaccatcgtacgaagggacacggaccgacgaaccacagttactatttaggaactagaaagaatttagaaatcgtagaccgacacggccgtaggttattagttcgnggtacggaacgaactaactcgttagtccggtaccgggtgtacgtcgtacgttaccggtagttaaccgttcggttcgggggacccaacggggttaacccgtggtaccgacccggttccttacccgtcgtaccggtccctaccggaacccgtaaccggggacccctaacggttccccggtttacccgttaccccccgttacgggtcccctaacccccggtttcccctaaccgtaacggtacccggtaaccctacccggttccggtaccgggggttaccaacccggtacggtccccgggtacccgttcggggacccgttcgggtaccccgttacgggtaccgtaaaccgggtaccttaaccgtttaccgggtaacggtcggtacccggttacgtccggttacggacggtccgggtcgtacgggcgtaacgggtaccncggtaccagcgtcgacgtnctacgg

SEQ ID NO: 147405 - DNA, 771 bp, Homo sapiens
  misc_feature: GYAE6OF02FGCXJ.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaattcttttgacgcagtctccaggcaccctgtctttgtctccaggggagagacgccaccctctcctgcagggccagtccgagtgtcagcagcaacctacttagcctggtaccagcagacgcctggccaggtcctccgaggtcctcctcactccagtcggtgcactccaacgcgggccacgtcggactacctaccccgaaggaccgtacgggtttaccaacgggtttgggacccgtagggttacgggggttacctaacggggtaaacctaacgggtaaccctttacccgtaacccggtttcccttaaccctaaacccgattacccgaaccggtaccgaaaccgggttaacggtacgggtaaccggtacccgttaaggtaaacggttaccgtttacgaccgtttaacgttttaacgttaaccgttcggttacgtcgtaccgtaacggtttacgttacggtttaacccgttcttaccgtttacgtttacgggttaacgttaacggttttccgggtcggggtacccgggtaacggtacgggtacggtaacgtaacgtaaccggaaaccggtaacgttcgggtaaggccgttacggaccctacgtacgttaccgttacgttaccg

SEQ ID NO: 147406 - DNA, 638 bp, Homo sapiens
  misc_feature: GYAE6OF02F5O0Z.3.23.C01.1.454.CMB.1.raw
  modified_base (630)..(630): a, c, t, g, unknown or other
  misc_feature (630)..(630): n is a, c, g, or t
  modified_base (632)..(633): a, c, t, g, unknown or other
  misc_feature (632)..(633): n is a, c, g, or t
  modified_base (635)..(636): a, c, t, g, unknown or other
  misc_feature (635)..(636): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctacgcaaaccagttccgaggcagagtcaccatgtcaagggacacggccgacgaacacagtactattcggaactagaagtaatttgaaattctagaccgacgacggccgtagtattagttgtgtcggagaactaacgttctggtcgtacggtcgacgtgaccgttaggtacgtagtttcggtcgggggacctacggggtacccgttgggtacctacccggtctccgctacgtcccgtacccaacccgacgggcccctacgttccggttcccttccccgtcgaccctcccctccctacctaacgaccgccgacccgtccggtcggggacctacgaccggccggtccgtcggcgtccggaccgtcggtaccgacggtaccttaccgtcggtactcggtcctacgtccgtggaccggcggtcgtcggcgtaacggcgtagagtacgncnncnncg

SEQ ID NO: 147407 - DNA, 901 bp, Homo sapiens
  misc_feature: GYAE6OF02HO5H0.3.23.C01.1.454.CMB.1.raw
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
tcagagacgcactccacgaccggtgctcgatttagtacacgtgattagggattggggagagctgctcagttaggacccagagggaaccatggaaaccccagcgcagcttctcttctcctgctactctggcctcccagactacccccggagtaaattcttttgacgcagtctccgaggcaccctgtctttgctccgaggganagacgccaccctctccngcgacggccaagtccgagtcgtacagcagaccaaacctacttacgccgtacggtaccagccaagacgacctcggacctaggcctacccgaggcctacctcactaccgagtcggtcacctactaccgaaacgtaccggggacctacggtcggacctacgtacccgaaggaccgtacgggttccacgggtccggacgtaaggggttccgggttacgtaacgggtaaaccgtaacgttaccgttaccgtaacccgtccgttaaacccgtaaccgtaacgttacccgtaacggtaacccgtaacgggttaaccggttaaccggggtacgtaaccccgtttagggaaaaaccgggttttccgtttacgggttaacccgttttaaaggttttttaaccgtttaaccggtttccggttttaacgtaacgggttacgtttaaagggttttaaccggttaacccgggttttaaccttttcccggtttaaacccgtttaacgggtttttacccgggttaaaccgttttaacccgggggtttacccgggacccgggttaccggggttaaacccgggttaccggggttagggtaaacccgttaaccgggttaaacccgtaaaacccgggtacggtttaaccggacggttaccgtaccggtacccgttaaaccgtcgtttaccggtacgttacccg

SEQ ID NO: 147408 - DNA, 678 bp, Homo sapiens
  misc_feature: GYAE6OF02FP1D1.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcacgggccagtcccgagtcgtcagcagcaaccacttagcctggaccagcagagacctggccaggctccgaggctcctcactccatggtcgcactcccaacgacgggcccaacgtcgggcctaactccccgaaggaccgtagggttccaaggtgggaccgaggttcggggtactagggaaacacggtacttccaactctacccgactactcacgtacacgacgtaggacgtaccgtaggaaacgttcgttacgacgtttaagttttacttacgtttcgtacgtcgtacgtaacgtttaggttacgttaccgtttactaccgttttacggtcgtttaaccgttaacgttttccggggaccgggttacgggtaaccggtaagggtaggaacggttaacgtaaccgtaaaacggtaacgttcggtaggtacgtccggacctaaccgtacgttacgttacgttccg

SEQ ID NO: 147409 - DNA, 678 bp, Homo sapiens
  misc_feature: GYAE6OF02IXZ3N.3.23.C01.1.454.CMB.1.raw
  modified_base (200)..(200): a, c, t, g, unknown or other
  misc_feature (200)..(200): n is a, c, g, or t
tcagagacgcactccacgaccggtgctcgatttagtacacgtgattagggattgggggagagctgctcagttaggacccagagggaaccatggaaaccccagcgcagcttctcttcctcctgctactctggctcccagatacccccggagaaattcttttgacgcagtctccaggcacctgtctttgtctccgagggganagagccaccctctcctgccgagggccagtccgagtgtcagcagccaacctacttagcctaggtaccagcagacgacctggccgaggcctcccgaggcctccgtcactccgtagtcgggtgccatccaacgcgggccacgtcgactactccaacgacgtaggttacaggtgacgtaggtcgggttactacggggaaactacggtaacctttacgtacccttaccgtaccctaacccgtaatccgaaccgacgtaacgaaccgtgggtaaccgtcgtacgtaaacggttacttttcggactttaaggttttactttaacggttcgtactacgtacgtacgttagttacggttactttcgtacttcgtttagtcgttaacgtttccgggacggtacggtaccgtaggtacggtaggtaacgtaacggtaaacggtacgttaggtcggtactacggacctaaccgtacttacgtcgttaccg

SEQ ID NO: 147410 - DNA, 989 bp, Homo sapiens
  misc_feature: GYAE6OF02FTNM2.3.23.C01.1.454.CMB.1.raw
  modified_base (201)..(201): a, c, t, g, unknown or other
  misc_feature (201)..(201): n is a, c, g, or t
  modified_base (224)..(224): a, c, t, g, unknown or other
  misc_feature (224)..(224): n is a, c, g, or t
tcagagacgcactccacgaccggtgctcgattagtacacgtgattagggattggggcctcagtgaaggtctcctgcaaggcgtctggatacgacgtcagcaggaggtatactcactgggtgccgacacggcccctggacaggcctgagtgatggaaatactccaaccctagtgactggtggcacgaagcctacgcaaccgngtccagggcagtacgtccacccngtcgtaccgaacgggtacccaccgggtcccgcgaaccaccgtacggtttacccgttagtttacgggaaaccgttacgaaaacgtaactttacggtaaaaccttccgtacggaacccggtaaccgtacccggggttaccccttaggttaactttacgtttacggtacgtaccgtaaacgtaactaaacgttccgtacggttaccggtacccggggttacaaccgttcgggttacccgttaacccgggttcccgtaacgttttcccggggtacggggtacccccgtaacggggttaaacccccgtttgggttacccccgtaccccgggtttacccttacccccgttccgtaacccgggtccccccgtttaccccggaacccccggtaacccggggtccccctaacccgttccccgggttacccccgttaccccccgtacgggtaccccctaacccccccgtacccgttaccccggtaaaccggtaccccggtacccgtaacccggtttacccgggttaccgggggtacctaaccccggggtaccggtacccccgggttacccggttccggggtacccctttaccgggaccccgtttacgggtaaccccggtaaccgggttaacccgttaacccggtttaccccgggtaattaccccgggtaccgttcccggtacccggttacggtaccggtacccgggggtaccctaccggggacccgtaaccgggtccggaaccgtacggttacggtccgcgtacgcgtccgtacg

SEQ ID NO: 147411 - DNA, 643 bp, Homo sapiens
  misc_feature: GYAE6OF02HN1F4.3.23.C01.1.454.CMB.1.raw
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
  modified_base (636)..(636): a, c, t, g, unknown or other
  misc_feature (636)..(636): n is a, c, g, or t
  modified_base (642)..(642): a, c, t, g, unknown or other
  misc_feature (642)..(642): n is a, c, g, or t
tcagagacgcactccacgaccggtgctcgatttagtacacgtgattagggattgggcctcagtgaaggtctcctgcaaggcgtctggatacaacgtcagcaggaggtatatacactgggtgcgacaggcccctaggacaaggccttgagtggatgggaataatcaaccctagtgatggtggcacaagctacgcaaacagttccagggcagagtcaccatgtcaagggacacggccgcgaaacacagtactagtttggaactggaagtaattttgaaaatctgacgactacggcctgtattatggtatacgaggtaaccaatctgtcgccggtgactgctaacggtcattctggggaccnggggaaaccctggtcacccggttctaccgtacncggtaccctcaacccgaaggggccctaagttcccgggtcctttaccccccgtgggcccgtaaccccttccctaccgaaacgtacggaccaacccgttcgttacggggggccacgaccgggccggcccgtcgggcgttacgccgtacgggtacgtaaaacgggccttaaccggttaccggtaacgtcggtaccggttctcgtacggtacggcgggctacggcgaaacggcgacgacgtaggtccnactcgnc

SEQ ID NO: 147412 - DNA, 703 bp, Homo sapiens
  misc_feature: GYAE6OF02HFDFO.3.23.C01.1.454.CMB.1.raw
  modified_base (322)..(322): a, c, t, g, unknown or other
  misc_feature (322)..(322): n is a, c, g, or t
tcagagacgcactccacgaccggtgctcgatttagtacacgtgattagggattggggagagctgctcagttaggacccagagggaaccatggaaaccccagcgcagcttctcttcctcctgctactctgctcccagactaccccggagaaattcttttgacgcagtctccaggcaccctgtctttgtctccgaggggagagagcccaccctctcctgcgacgggccagtccgagtgtcagcagaccaacacttacgcctggtaccagcaagacgaccgtcggaccgaggcctcccgaggcctccgtcactccgagtcggtcncactaccgaacgacgggacctacgtcgacactcccgagaccgtacggtcgagtcggacgtaggtcgggtacgtaggaacgacggttaccttaccaccttccacccgtacctaagtccgacgtacgtaacgccggtaggtacgttaccgtagaaacgttccttacgtcgtacgtttaacgttttaccttacgttacgaccgttacgtacgttaacgttaactttaacgttaacggtcggtaacggttacgggtaacccggttacggaaccggtaaacgggtaaccgggaagggttaccggtaaacgtaaccggtaaacggtaacggtacgggtaggtaccgtcgtaacccacggttattacggtcttacccgtacttacccg

SEQ ID NO: 147413 - DNA, 814 bp, Homo sapiens
  misc_feature: GYAE6OF02FMPJB.3.23.C01.1.454.CMB.1.raw
tcagagacgcactccacgaccggtgctcgatttagtacacgtgattagggattggggagagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctaggtaccagccagacgacctggccaggcctcccgaggcctaccgtcacttcccagttcgggtcgaccgtaattcccgaaacgtacggggcccctaacgttcgggacctaaccgttcccccgaaaggtaaccgtacggggtttacccaacgggtttcggggaccgtaacggggttccgggggtttaccttaacggggaaaaccctaagggttaaccccgttttaccgaacccgtttaccctacccgtaacccggtaattaccgaaccggtacgtaacggtaaccgttacggggaaccgtacccgttaacggaaacgttaccgttttaggaccgtttaaggttttaactttaccgttggttaccttacgggtacgttaacggtttaacgttacgggttaacctttaccgtaaccgttttccggtttacgggttaaccgttaaccggttttaccgggaccgggtaccgggtaaccgtagggtacggtacgtaacgtaacgtaaaccggtacgttacggtacggtccgtagtacccgtaacgtacgttaccgttacgttacccg

SEQ ID NO: 147414 - DNA, 674 bp, Homo sapiens
  misc_feature: GYAE6OF02FM7TU.3.23.C01.1.454.CMB.1.raw
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (358)..(358): a, c, t, g, unknown or other
  misc_feature (358)..(358): n is a, c, g, or t
  modified_base (393)..(393): a, c, t, g, unknown or other
  misc_feature (393)..(393): n is a, c, g, or t
  modified_base (670)..(670): a, c, t, g, unknown or other
  misc_feature (670)..(670): n is a, c, g, or t
  modified_base (673)..(673): a, c, t, g, unknown or other
  misc_feature (673)..(673): n is a, c, g, or t
tcagagacgcactccacgaccggtgctcgatttagtacacgtgattagggtagttggggcctcagtgtaaggtctcctgctaaaggcgtctggatacgacgtcagcaggaggtatatacgactgggtgcgacgacgggcccctggacaaggccttgagtggatgggaataatcaacccttacgtcgaatggtggcacaagcgtacgcgaaaccagttccagggcagagtcacatgtcaggacacggcgcgaacacagtctattggaactganaatttgaatnagacgtacacggcgtgtacttaatgtagacgtacggacaagtctggtgccggttgactcgactacgtcgatttcgnggggacaggggaaccctggtccgaccgtctcctcngcctccgaaccgaaggtaccccagttccggtaccttccccgtcggtacctacccgtaaccgtccctaaaggtaccgaccgtaccgtacccggttccggggggacccgtaaacccggtcgggtaacccggtccccgttacgggtccgttaccgggccccgttacgggttacccgaaccgggttaaaccgtacccgtttcccgaacggtttccgccgttccgtacgtcggaacggccgggtctaggtaccgaaccgtcggaccgtagtacgcgacggcngcnc

SEQ ID NO: 147415 - DNA, 567 bp, Homo sapiens
  misc_feature: GYAE6OF02FUTHB.3.23.C01.1.454.CMB.1.raw
  modified_base (314)..(314): a, c, t, g, unknown or other
  misc_feature (314)..(314): n is a, c, g, or t
  modified_base (454)..(454): a, c, t, g, unknown or other
  misc_feature (454)..(454): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(564): a, c, t, g, unknown or other
  misc_feature (564)..(564): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctattggaactgaagtaatttgaaatctgaacgacacggccgtagtattattgtgcgaggactaatntgtgccggtgactgctacgtcgtattcgtggggccagggtaaccctggtccaccgtctccgtcacgcctccaaccgtacggcccagtccgtccttccccgtcgccacccctccaccaacgacgccacctcgcgggtcacncggccgcccgtgggcctcgccgtggtaccgaacgaccttacgttccgagtcgtccgtactccgtagacggcgggtcgtggtaccggaacggcgtacgagtacggnanncntcg

SEQ ID NO: 147416 - DNA, 771 bp, Homo sapiens
  misc_feature: GYAE6OF02GAPP9.3.23.C01.1.454.CMB.1.raw
  modified_base (189)..(189): a, c, t, g, unknown or other
  misc_feature (189)..(189): n is a, c, g, or t
  modified_base (261)..(261): a, c, t, g, unknown or other
  misc_feature (261)..(261): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggcccctggacaacggccttgacgtggatgggaatatacaaccgtagtgatggtcggcaanaagctacgacaaacgtcgttccgaggcaagacgtccactagtcgtacgaagggaccacgggccgtacgaacnccgaagttccttaagttcggaaactagaagtaaattaggaactctaggaacgacgtacgggtccttagtactttagttggtaggacggaagggaactaacttccgtggtaccggtcgggtacacgttcggacttacggtcgttattttccgggaacggggtaccgaaccggggtaacccttgggtaccctaccgttcccgtacgtcgaccgtcccgtaacaaaccccggacgggtccccttaacgggtcccgtttcccgttaccccgtaccggtaccctaccccgtaccccgtaccgaaacgaccggacccgtaacccggtcgggtacgggtaacccgacggtaccgggtacccgggtcccgggtacggtccgtaccggtccggttacgggtaccgtaacggtaaccgttaaccggttcgttacgttaccggtccgttcgtccggttacggacggtccggtccgggttacggacgaccgggtacgacggtactacgggtacngntagcta

SEQ ID NO: 147417 - DNA, 717 bp, Homo sapiens
  misc_feature: GYAE6OF02HG499.3.23.C01.1.454.CMB.1.raw
tcagagacgcactccacgaccggtgctcgatttagtacacgtgattagggagttggggagagctgctcagttaggacccagagggaaccatggaaaccccagcgcagcttctcttcctcctgctactctggctcccagactacccccggagaaattcgttttagacgcagtctccaggcaccctgttctttgtctccaggggagagacgccacctctcctgcacgggccacgtcgagtgtcagcagccaaccacgttacgcctaggtaccagcaagacgaacctggaccgaggcctaccgaggacctccgtacatccagttggcgacacgtacccgaacgacggccacgtcggacctactaccccaaggaccgtacggttcaggtcggacgttaggtggtccgtaacgggaactacggtaactttcgaaccttccgtaccctaaccgtactacgaacgtccgaaaggtaccggtaggaaccgtccggtaaggtaaacgttcgtttagtaaccgttagttttaaactttacgttccggttcgttacgtacgttagttaggttacgttaacgttccgtacgttggttacgtttacgtacggtttccggaccgggtacgtaacggtagggttacggaacggtaacgtaaccgtaaaggtaccgtacgggttacggacgttaccgaccggtttaacctacggttttaccgtacgtttaccg

SEQ ID NO: 147418 - DNA, 640 bp, Homo sapiens
  misc_feature: GYAE6OF02JCMPQ.3.23.C01.1.454.CMB.1.raw
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
  modified_base (636)..(636): a, c, t, g, unknown or other
  misc_feature (636)..(636): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaacagttccagggcagagtcaccatgtacaagggacacggccgacgaacacagtctattggaactgaaagtaattagaatctagacgtacacggccgtgtattattgtgacggtaggacaagtctagtgtaccggtnaactggacttacgtacgtatttcgnggggcctaagggaccctggtacaccggttcctactcgacgtaccctacccgaaccgaacggtccccagttcccggtacccttccccccgtacggtacccctacccctcccgtaccgaaacgacgtacctacccgtcggtcggggtaccacgacgccgggtacccgtcggtccgtcgtccgtacggtaccgaacggtacctaccgttcgacgtcggtccgttacctcgtaggacgccgggtactcggacgtacggacgtacgtactacggactagctacgntacg

SEQ ID NO: 147419 - DNA, 689 bp, Homo sapiens
  misc_feature: GYAE6OF02HE7AI.3.23.C01.1.454.CMB.1.raw
  modified_base (198)..(198): a, c, t, g, unknown or other
  misc_feature (198)..(198): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
tcagagacgcactccacgaccggtgctcgatttagtacacgtgattagggattggggagagctgctcagttaggacccagagggaaccatggaaaccccagcgcagcttctcttctcctgctactctggctccagactaccccggagaaattcttttgacgcagtctccaggcaccctgtctttgtctcgaggggtanagagccaccctctcctgcagggccaggtccgagtcgtcagcagccaactacttagcctaggtaccagcagacgacctcgggaccaggtcctcccgaggcctcctcgactcctagtcggtcncactccaacgcgggccnggtcggcctacgtcccgaaggtacctagggttacaggttacggcgtaggtcggggttactacgggaaactgtaccttcacgttccgtactaccgataccgagcgacgtacgtacggcgtacgtagtaacgttcgttagtacgttaacgttttacttacgttcgttctaggtacgtacggttacgttacgttaccttacgtacgtttccgttacgggttacttacgggtttaccgggaccgggttacggtaaccggtacgggtacggttaacgtaacggttaaccggaaacggttaaccgttgggttacggccggttacgaccggttaaccgttcggttacggttcgttaccgg

SEQ ID NO: 147420 - DNA, 735 bp, Homo sapiens
  misc_feature: GYAE6OF02HYZ9E.3.23.C01.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagagacgcactccacgaccggtgctcgatttagtacacgtgattagggattggggagagctgctcagttaggacccagagggaaccatggaaacccagcgcagcttctcttcctcctgctactctggctccagactacccccggagaaattcttttgacgcagtctcaggcaccctgtctttgctccgagggganagacgccaccctctcctgcgacgggccagtacgagtgtacacgcacgacaacctacgttacgcctacggtaccaaggcaaggacgaccgtcggacctcggcctacccgnggtcctcctcgaactccagtgcgacactaccaacgcggacctacgtcggaccacgtaccccaaggaaccgtacggttaccgagttcgacgtacgggtcggtaccgtgggaaactaggtcctaacgcgtactccaacgtacgtacgacgtacgacggtacgaggtaccgtacggttacgaacggttaccttaggtacgttaaacggtttaacttttacgttacggttccggtaggtaccttaagggtttacgttaccgggtttaaaccttcgtaaccgtttacggttacgttaacgtttaccgggttaccggggtaccggtaacccgggggtttaacggaaccggggttacggtaagtaaccgttaaaccggaacgtaccggttacggtacgtacggtccgaacctacgtccgtttacgtctttaacccg

SEQ ID NO: 147421 - DNA, 678 bp, Homo sapiens
  misc_feature: GYAE6OF02ICTMT.3.23.C01.1.454.CMB.1.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
tcagagacgcactccacgaccggtgctcgatttagtacacgtgattagggattgggggagagctgctcagttaggacccagagggaaccatggaaaccccagcgcagcttctcttcctcctgctactctggctccagatacccccggagaaattcttttgacgcagtctccaggcacctgtctttgtctccgagggganagagccaccctctcctgcgacgggccagtccgagtcgtcagcancaaccattgcctggacagcagacgacctggccaggcctaccgagtcctcctacactcagtggtcacctaactaccgaacgacgggtaccaccgtcggacctacgtaccccaggtaccgtacgttacggacgttcggacgtacgggtcggtactaggaacacgtcttaccaccttcacctactacgtcgaacgcgtaacgtacggtacggactcgtaacgtagttaccgttgaacgtttctttaacgtttcacgttcgtcgtacgttaagtttacgttccgttaaccgttacgtacgttacggtttcgtaacgttacggtttaccgggccgggttaccggtaacgtaacgggttacgaacgggttcctaaaccgggttacgaccggttacggtacgtaccggttcgaacccgttacgttacgtccgtagttacccg

SEQ ID NO: 147422 - DNA, 816 bp, Homo sapiens
  misc_feature: GYAE6OF02H8RQG.3.23.C01.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
tcagagacgcactccacgaccggtgctcgatttagtacacgtgattagggattgggggagagctgctcagttaggacccagagggaaccatggaaaccccagcgcagcttctcttcctctgctactctggcctccagactacccccggataaatttcttttgacgcagtctccaggcncctgtcttgctcgagggngagcgccnccgtctcgtgccgaggccacgtccggagtcgtcagacgacgaccaaaccctagttaccgcgttcggtaaccgacggactaacggacgaccgttgggacccgacgggtccctaccccgagggtccttacccctagtaccttacgacggttacgggtcaccggtttaaccaaccgtaacggaccgggtaccctacggtcggacccttaacggtaccccgaaggtacgttaaacgggtccgtaggaccgggtaacgtggggtacgggttacgtaacgggtaacaggtctttaaccgaccgttccgtaccaacgttaccgctaacggactaacggaaccgtttgggaacgtaccgtttaggaaacgtttacgttaacggttacgttaaaccgtttttcgttaaacgtcgttaaccgttaacggtacgttaaaggttccgtttaacgggttaacctttaccggttaccgtttacgtttaacgggtttcttaaccgggtttacgggtaccggttaaccgggagttaacgggagggtttaaaccgaccggtaaccggttaaagtaccggtttacgacggtacttcggacccggttaacttcggttccgtaacgttaccg

SEQ ID NO: 147423 - DNA, 660 bp, Homo sapiens
  misc_feature: GYAE6OF02JVCJC.3.23.C01.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (478)..(478): a, c, t, g, unknown or other
  misc_feature (478)..(478): n is a, c, g, or t
  modified_base (638)..(638): a, c, t, g, unknown or other
  misc_feature (638)..(638): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctccgagactaccccggagaaactttcttttagacgcagtcctaccaggcaccctgtctttgtactccgagggagagcncccgaccctcctcgtncgacgggtccagtccgagtcgtcacgtcgacgaccaacctacgttacgcctacggtacccaggtacaggtacgacgtcggaccgaggtccctccgaggtacctcctactactccgtagtcgtacgaccacttacccgaacgtaccgggccaacttcggacacccgtaccgaacgtacggtagttacgcggtagacggttacgggtacgtacgtaggtaaccgtcacgttcctaccgtacaccaatgtcacganacgtacgtcgacgcgtaagtacgtctacgatttacgttacgttactcgtcgtgtacgtagtacgttagtaccgttacttacgcttacgttcgtacttacggtccgggtacgacggtacgtaggtacgtacgactacgtaacgtacgttagacggttaccngtaccgtacgttctacgttacg

SEQ ID NO: 147424 - DNA, 666 bp, Homo sapiens
  misc_feature: GYAE6OF02FW766.3.23.C01.1.454.CMB.1.raw
  modified_base (138)..(138): a, c, t, g, unknown or other
  misc_feature (138)..(138): n is a, c, g, or t
  modified_base (149)..(149): a, c, t, g, unknown or other
  misc_feature (149)..(149): n is a, c, g, or t
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagntacccccgganaaattctttgacgcagtctcagcacctgtcttgtctccagggganagcgccaccctctacctgcgacggccagtccgagtcgtcagcagccaaccacttagcctaggtacccagcaggacgacctggccaggcctccgaggctcctnatccatggcncgactccaacacggccactggccacgtccgagactaggttcagttcggatgggtcggtacnggaactagaccttcaccttcctaccgacctagtacaacggtacgtagtaccgtacggtaggtaccctaaaggtacccgtttcgtttaaccgacgtttaacggttttaaactaccgttacgttccttacggacgtttacgttacgtttacggtacttacgtcttagttacggtacttccggtttacgggacggttaccgggtacgtacggttagggaaccgttacgtaaaccggtaaaccgggtacgttaccgggtaggttccgtacgacccggtaaacttcgttaccggttaccttccg

SEQ ID NO: 147425 - DNA, 741 bp, Homo sapiens
  misc_feature: GYAE6OF02G3118.3.23.C01.1.454.CMB.1.raw
  modified_base (321)..(321): a, c, t, g, unknown or other
  misc_feature (321)..(321): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggcctcccagactacccccggagaaacttcttttgacgcagtctcaggcaccctgtctttgtctccgagggagagacgccaccctctcctgcgagggccagtccgagtgtcagcacgacaacctactacgccgtaggtaccagcagaacgacctggccaggcctccaggcctacgtcacgtccagtcggtacnctaactaccgaacgacgggtaccacgtacggaccaacgtcccgaagtaacgtacggttaccaaggttcggacgtaagggttcgggtacgtaagggaaacgtacgtaaccttacgtaaccctacgtaccgaaccctaagtaccggaacgtacctaaacgggtacgtaacgggaaccgtccgtaaaggtaaacgttacttttacggaacttttaagggtttaacttaccgtcgttactaggtaaccgtaaggttacgtaggtttacctacgttaacttaccgttaggttaactacgggtttaccggacggggtaacccgttaacggtagggtaaccggtaacgtaaacgtaaaccggtaaacggtacgttgggtaacgttaccgtacggtaacctaaccgttacgttacgttaccttaaccg

SEQ ID NO: 147426 - DNA, 599 bp, Homo sapiens
  misc_feature: GYAE6OF02H9PDZ.3.23.C01.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (598)..(598): a, c, t, g, unknown or other
  misc_feature (598)..(598): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaacctagtgatggtgcacaagctacgacaaaccngttccagggcagagtcaccatgtcaagggacacggccgcgaacacncgtactatttggaactagaagaattagaaatctagacgacacgcgtgtacttattgtgtcgaggtacaatctgtcgccggtgactgctacgtagactttcgtgggccacggtacctggtccaccgtctacgtcacgcctacaacccgaacgggcccacgtccggtaccttcccccgtacggtacctacccctccctacgtaacgacgacctacccgtacgtcggggtaccaacggacgtcccggacccgtcgggtacctcgccggttacgtcgaaacgtacgtaccgttaccgagtcgtcgtgtactcggacgtcggtcgtacggcgaacggcgtacgaacgtgactgactagcng

SEQ ID NO: 147427 - DNA, 795 bp, Homo sapiens
  misc_feature: GYAE6OF02IQCT3.3.23.C01.1.454.CMB.1.raw
tcagagacgcactccacgaccggtgctcgatttagtacacgtgattagggattgggggagagctgctcagttaggacccagagggaaccatggaaaccccagcgcagcttctcttcctcctgctactctggctccagactaccccggagaaattctttgacgcagtctcaggcacctgtctttgctccgaggggacagacgccaccctctccgtgacgtacggccagtccgagtcgtcagcagccaaccacttacgacctggtaaccaggctaagacgaccgtcggaccgacggctacccgaggacctcctacacgtaccaaggtcggtacgactacgtaccgaaacgtacgggacctaacgtcggacctacggtaccgaacgtaaccggttacggtaccgagggtacgggaccgtaaacgggttcggtaacgttaacggggaaaacctacggtaactttacccgaacgttacccgttaaccgaaccgtagttaacccgtaacggtacccgaaacggttaacgggttacgggtaacgtaaccgttaacggaaaacggtttaccctttaaggaccgtttaaaggttttaaccttaaaccggttacggttacgttacgggtacttaacgggttaacgttccggtttaaaccttaccggtacgttttccggttaacggttaaccggtttaacgttcggggtaaacggtacccgggtaacgtaacgggtaggaacggtaacttaaccggaaagttccgtaggtacctcggtacgacccgtagtaccttcgtaagttccg

SEQ ID NO: 147428 - DNA, 769 bp, Homo sapiens
  misc_feature: GYAE6OF02HKTEI.3.23.C01.1.454.CMB.1.raw
  modified_base (210)..(210): a, c, t, g, unknown or other
  misc_feature (210)..(210): n is a, c, g, or t
  modified_base (760)..(760): a, c, t, g, unknown or other
  misc_feature (760)..(760): n is a, c, g, or t
tcagagacgcactccacgaccggtgctcgatttagtacacgtgattagggattgggggagagctgctcagttaggacccagagggaaccatggaaaaccccagcgcagcttctcttcctcctgctactctggctccagataccccggagaaattcttttgacgcagtctccaggcaccctgtcttgtctccgagggagagagccaccctntccgtgcgacgggccagtacggagtcgtacagcaagcctaaaccacgttagccgtaggtaaccagtccaagacgtaccgtcggccgtacggcctacccgaaggcctacctacgaacttcccaagttcgggtactacgtaacttaccgaaacgacgggtaccctaacggtcggacaccgtacccgaagtaccggtaggtaccgacggtacggacgtaagggttcgggtacgttaggaaaccgtaagtacccgtttacgaccttaccgtacctaacccgtagttaccggaacgtaccgaaggtaccgttacggaaccgttaccgtaacggtaacgttaaccgttacgggtaacttaacgttttacgtaccgtttacgttaccgacgtacgtaagttacggtaacgttacgttaacctccgtttaacgtttacggtaccttaaaccgggtttccgggaacgggtaccgggtaaccggtagggtacggaaccggtaataaccggtaaaacggttcgacgggttacgcgtaccggtaactaccgttatcccggtnttaacccgg

SEQ ID NO: 147429 - DNA, 620 bp, Homo sapiens
  misc_feature: GYAE6OF02H3XVB.3.23.C01.1.454.CMB.1.raw
  modified_base (614)..(617): a, c, t, g, unknown or other
  misc_feature (614)..(617): n is a, c, g, or t
  modified_base (619)..(620): a, c, t, g, unknown or other
  misc_feature (619)..(620): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggaacaaggccttggagtggatagggaataatccaaccctagtgatggtggcacaagctacgacaaacagttccagggcagagtcaccatgtcgaagggacacggccgacgaacacgagtactatttacggaactggaaagtaattttagaaaattctagacgacgacggtccgttgtatttattgtcgacgaggaactaatcgttgcgccggtagactgacttacggtcgtagttttcgaggggtaccaacggggtaacccttgggtaccacccggttcctcctacgacgtccctacccgacccggtaacggccctacgttcccggtccttccccgtcggccctacccctcccgtaccacgacgtaccaccgtcgtcgggaccacgacgccggtcccgtcgggccgtcgtaccgtcggtacgaacgtacgttaccgttcgaacgtgcgtctcgtcgcggcggcgtcgcgagcgcagcgnnnngnn

SEQ ID NO: 147430 - DNA, 673 bp, Homo sapiens
  misc_feature: GYAE6OF02HM27A.3.23.C01.1.454.CMB.1.raw
  modified_base (322)..(322): a, c, t, g, unknown or other
  misc_feature (322)..(322): n is a, c, g, or t
  modified_base (656)..(656): a, c, t, g, unknown or other
  misc_feature (656)..(656): n is a, c, g, or t
  modified_base (668)..(668): a, c, t, g, unknown or other
  misc_feature (668)..(668): n is a, c, g, or t
tcagagacgcactccacgaccggtgctcgatttagtacacgtgattagggattgggggcctcagtgaaggtctcctgcaaggcgtctggatacgacgtcagcaggaggtatatacactgggtgcgacacggcccctggacaaggccttgagtggatgggaataatcaaccctagtgagtggtggcacaagctacgacaaaccacgttccgagggcagacgtcaccagtgtacgaaaggaccgaccgggccgacggaacacacgtacttattggaactagaagtaatttagaaatctagacgaccgacggtccgtagttattntggtcgacggacggaacactcgttacggtcggtcggtacgtactcgtctacgtcgttagttcggcggggtaccgacgggtaccgtggtacctacgtcctcctcgctacccgacccaacgtaccggcccgtcgttcccgtcccgtccccgtcgcccctcccgttacccaccgtaaacgacgtcctaccgtcggacgggtcaccgcggtcccggccgtcggtacgtcgtccggttacgaaccgaacgttcgtaaccgttccgtaacgttcgcccgttcgtccgtagggtccggtccggtacggccggtaaggtcccggacgtacgtaacggttacnggaactggacgngtacg

SEQ ID NO: 147431 - DNA, 550 bp, Homo sapiens
  misc_feature: GYAE6OF02GA6EC.3.23.C01.1.454.CMB.1.raw
  modified_base (199)..(199): a, c, t, g, unknown or other
  misc_feature (199)..(199): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcacaagctacgcaaaccngttccagggcagagtcaccatgtcaagggcacggccgcgaacacagtctattggaactgaagaatttgaaatctagacgacacggcgtgtattattgtgcgtaggactaagtctggtcgccggtgactgctacgtcgtattcgcggggccaagggtacccgtggtaccgtcgtctcncgacgtcctaccgacggaccgctacgtcctccctccgcacctcccnctaacagctaccgtcgtggcggacacgccgccgcgtcggctcgtacgtgaacgaccgtacttcgtcgtgtccgtcgtcngtacggcggtcggtcggcgaccggngtccgagtagcgcngntcgtancg

SEQ ID NO: 147432 - DNA, 605 bp, Homo sapiens
  misc_feature: GYAE6OF02GSTH1.3.23.C01.1.454.CMB.1.raw
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (493)..(493): a, c, t, g, unknown or other
  misc_feature (493)..(493): n is a, c, g, or t
  modified_base (593)..(593): a, c, t, g, unknown or other
  misc_feature (593)..(593): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtggcaacaagctacgacaaaccagttccagggcagacgtcaccatgtacgaagggactacggccgacgaacactagtctagttcggaactgaagtaatttggaaatcgtagacgacgacggcgtagtattatgtagcgaggacaatctgngcggtgactgactagtcgtattcgngggccaggaacctgtacaccgtctacctacacgccctaccaccgaacggccctaagtccgtccttaccccgtgtaccctaccctcccgtaccaacgtacgcctaccgtcgtacggggacacgtacgccgaccgtcggacncgtccgtacggtaccgtaacgtacctaccgttaccgagtcgacgttcctacgtacgtacgaccgggtctacgggacgaacggcgtacgtaacgtacggtnacgactgtagcg

SEQ ID NO: 147433 - DNA, 675 bp, Homo sapiens
  misc_feature: GYAE6OF02GKG12.3.23.C01.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (627)..(627): a, c, t, g, unknown or other
  misc_feature (627)..(627): n is a, c, g, or t
  modified_base (674)..(674): a, c, t, g, unknown or other
  misc_feature (674)..(674): n is a, c, g, or t
tcagagacgcactccacgaccggtgctcgatttagtacacgtgattagggagttgggcctcagtgaaggtctcctgcaaggccgtctggatacgacgtcaggcaggaggtatatacactgggtgcgacacggcccctggacaacgggtccttgacgtggagtgggaataatcaaccctagtgatggtaggcacaagtctaacgcaaaccngttccagggcanagtcacatcgtacgaagggacacggccgacgaaacacctagttacttagtttcggaaactaggtaacgtaatttacgaaattcgtagaccgacgacggtccgttagtagttattaggtgacgtaaggtacctaatcgtgtacggaccggttcacgtgtaccgtacgtcgtattcggtcggcctaacgggtacctcggtactacccggtctacccgtcaccgtcctaccgaacccggtaggaccccgtagtcccggtcccttccccgtacgtacccctaccccgtacccgtaccgaacgtacgaccgtccaccggtaccggggaccacggtaccgaccggccggtaccgggcgtacgaccgtggtaaccgtacggtacttaccgtcgtagtccgtagtccgttacncgcggccgtgtaccggtcggacgttcggactagacgtgacgctgacng

SEQ ID NO: 147434 - DNA, 779 bp, Homo sapiens
  misc_feature: GYAE6OF02IXKT2.3.23.C01.1.454.CMB.1.raw
  modified_base (193)..(193): a, c, t, g, unknown or other
  misc_feature (193)..(193): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaactttctttgacgcagtcctaccaggaccaccctgtctttntcttaccgaggggagagacgcccaccctctaccgtgcgacgggccagtccgagtgtcgagacgacgaccgacctactacgccgtacggtaccaggaccgagacggtaccgtgggacctacggtaccctaccccggacggtccttacccgtcaccgtaccgtaggtcgtcgacctaccgtacccgaaccggtacgggaccccgacgtacggcctaccgtacccgacggtaacgtacggttaccgaggttacggacggtacgggtttcggaccgttagggaaacacggttaccgtttacacctaccgaacctacctacgtaccgtaacgaccgttaccgaaccggtagaccgtacgacgtaacgttacttacgaactttagggtttaactacgtttacgtaccgtacgtacggtaaccgttaacgttaacggttaccgttacgggtacggttaacggtaccggttacccggaacgtaccgggtaaaccgttacgggaacgtaaccgtaacgtaaccggtaacgttacggtacggtacgttacggaaccgtacgtcgttacgttacgttaccgtacgtacccttacccg

SEQ ID NO: 147435 - DNA, 670 bp, Homo sapiens
  misc_feature: GYAE6OF02J1H84.3.23.C01.1.454.CMB.1.raw
  modified_base (544)..(544): a, c, t, g, unknown or other
  misc_feature (544)..(544): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagataccccggagaaattcttttgacgcagtctccaggcaccctgtctttcgtctccgaggggagagacgccaccctctcctgaccgagggccacgtccgagtcgtcaggcacgacaacctacttacgccgtacggtaccgagacgacggacgaccgtggaccgacgtccgtaccgaggtcctccgtacactccgagtggtcgactaccgaccgaacggacggtaccacggtcggactaccgtaccacgtacgacggttaccgaggtacggacggtacggtcgggtacgtacggtaacacgttactaccgactacctacgacctagtccgaagcctacggacgtcggtaacgtcgtaaccggtaacgttaccgttagtaacgttacggtttaacttaacggtcgtacgngtaactagttacggtcgtttacacttacgttgtacgtagttaccggtcggacggtaccgtaggtagacggtacgaacgtaaccgaagtagtcggtagactacgacgttacacgttccgtagttacc

SEQ ID NO: 147436 - DNA, 802 bp, Homo sapiens
  misc_feature: GYAE6OF02JGMD9.3.23.C01.1.454.CMB.1.raw
  modified_base (198)..(198): a, c, t, g, unknown or other
  misc_feature (198)..(198): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggcccctggacaaggccttgagtggatgggaataatcaaccctagtgatggtgcacaagctacgcaaaccngttccagggcagagtcaccatgtcaagggacacggccgcgaacacagtctagtttcggaactggaaagtaatttagaaatcgtacgaacgaccgtaccggtcgttagttattagtttaggtagggacggtaacggtaaccgtaaacgttcggttacgtacgggtacccgggttaggtacgttacggtaccgtacggttacgttaacggttttcgtaccgggggtaccggtaaccggggtaaacccggtcccgggttacctaccccggttcccgttacccgttccgaaccggtcccctaaccccgaaccgggttaaacccgggacccgtaccgtttaacccgggttcccctttaccccccggttaccggttccccgtaaccccctcccgtacccgtaaccggacgttacccgacccgttacgggttccggggacgtacccggaaccgggcccggacccggttcgggtccgttcgggcccggttacgtaaccggaccggtaccttaccggttacgtcggtacggtccgttcttccggtacggtcggtaccggggtcggttacggaccggaacggtcggtaacgaccggtagaccgtcgcgactgcg

SEQ ID NO: 147437 - DNA, 795 bp, Homo sapiens
  misc_feature: GYAE6OF02IP37N.3.23.C01.1.454.CMB.1.raw
  modified_base (789)..(789): a, c, t, g, unknown or other
  misc_feature (789)..(789): n is a, c, g, or t
  modified_base (795)..(795): a, c, t, g, unknown or other
  misc_feature (795)..(795): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacgacggccctggacaaggccttgagtggatgggaatatcaacctagtgatggtggacactaagctacgacaaaccagttaccagggcagagtcacatcgtacgaaggacacggccgacgaacacagtcttattacgaactgaagtaattgaaatctacgaacgacacggtccgtagtaattacgttagaggtacggtaacgggactaacgtcgtaggtacggtaccggttgtaacgtccggacgttaccgttaccgacttttacgcgggggtacccgtaaggggtaaaccccgttgggtaccctaacccgttaccgtaccgttaccgtaacgtaccccgttacccaacccgggaaaccgggtacccctaagtaccccggttacctttaccccccggtgggaccccttccccgtaacccgtacccgtaaacgaccgtacctaacccgttccgggtaccggggtacctaacccggaaccggtccccgggccccgttaggggacccgttggttaccccgttaggggtaacccgtaaacggggttaaccctttaaccgggttacccgttacggttaccggttaccgttacccttacgggtcgtaacgggtccggggcttacgggaaccgtaacggggtaaccgtacgtaacggttaagccgaggtacncgtatn

SEQ ID NO: 147438 - DNA, 813 bp, Homo sapiens
  misc_feature: GYAE6OF02JGG1I.3.23.C01.1.454.CMB.1.raw
  modified_base (809)..(809): a, c, t, g, unknown or other
  misc_feature (809)..(809): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacacggccctggacaaggccttgagtggatgggaataatcaaccctagtgagtggtgcacagctacgacaacagtcaggcagagtcacagtcgtcaaggacacggaccgacgaactacgagtctaagtttacggaactacggtaagtaaacttggtaaactacgttacggtaacggaacgtaccgggtaccgttagttacgtttaaagttcggttacgaaccggagggtaaacctaacttaccggtggttacgtaccgggttagtaaccggttacgtacgttacgtacccggttaagttttccggacgggggtacctaaccgggggtaacccgtttggtaaccccgttacccggtcccgtacccgttacccgtaaccgtaccccgtaaccccgtaacccggaaccggggtacccctacggttacccggttacccgttcccccggtaccggtacccctacccccggttaccccgttacccgaaaccgtaccgtaacccgtacccgttcccggtaaccggggtacccgtaccgaaccgggtcccgggacccgtaccgggtcccgtcggtacccggtcggttaacccggtacggtaacccgttaacggttcccgtacggtcgtccggtctaccgtcggaccggtccggccggtggacgaccggtcgtacgtagacggtactgctacgngacg

SEQ ID NO: 147439 - DNA, 591 bp, Homo sapiens
  misc_feature: GYAE6OF02GEBYU.3.23.C01.1.454.CMB.1.raw
  modified_base (98)..(98): a, c, t, g, unknown or other
  misc_feature (98)..(98): n is a, c, g, or t
  modified_base (576)..(576): a, c, t, g, unknown or other
  misc_feature (576)..(576): n is a, c, g, or t
  modified_base (584)..(585): a, c, t, g, unknown or other
  misc_feature (584)..(585): n is a, c, g, or t
  modified_base (587)..(589): a, c, t, g, unknown or other
  misc_feature (587)..(589): n is a, c, g, or t
tcagagacgcactccacgaccggtgctcgatttagtacacgtgattagggattggggcctcagtgaaggtctcctgcaaggcgtctggatacgacgtnagcaggaggtatatacactgggtgcgacaggcccctggacaaggccttgagtggatgggaataatcaaccctagtgatggtggcacaagctacgcaaaccagttccagggcagagtcaccatgtcaagggacacggccgacgaacacagtctatttggaactgaagaatttagaaatctagacgacacggccgtgtattattgtgcgaggacaatctgtgccggtgactgctacgtcgtatttcggtcggggccacggggaaccctggtccaccgtcctcctcacgccctccaccgacggcccagttccgtccttccccgtcggccctacccctccctaccaacgtaccgcctacccgtcggtcggggtccaccgacggcccggtacccggtcgggccgtcggccgtcggtacgaacggtacctaccgttccgtacgtcggtccgtctcgtggacggtccgggcgtcggcgacggcgngacgtcgnngnnngc

SEQ ID NO: 147440 - DNA, 830 bp, Homo sapiens
  misc_feature: GYAE6OF02FRBRZ.3.23.C01.1.454.CMB.1.raw
  modified_base (340)..(340): a, c, t, g, unknown or other
  misc_feature (340)..(340): n is a, c, g, or t
tcagagacgcactccacgaccggtgctcgatttagtacacgtgattagggattggggcctcagtgaaggtctcctgcaaggcgtctggatacgacgtcagcaggaggtatatacactgggtgcgacaggccctggacaaggccttgagtggatgggaataatcaaccctagtgatggtggcacaagctaacgacaaaccagttaccgagggcagagtcaccgagtcgtacgaagggaccacggccgacgaaaccacagtacctagtttcggaacctggaagtaatttagaaactacgtagtaaccggaactaccgggccggttagtaactttagttcggnggtacggtaacggacctaaacgttccgtaggtcggtaccgggttcgtaccgttcggtttacgtaccggttcttttaccggtccggggtaccgacgggttaaacccgtcgggtaccctaccccggttacttccccgtacgacgtccccttacccgaaaccggaaccgggtacccctaacggtttcccggttacccccgtttcccccggtacggtaccccttaacccccgttacccgttaacccggaacggtacccggtaccgtaacccgttccggggtaccggggtaccgaaaccggtacccgggtcccggaccccggttgggtaaccgtcccggtcccgttaagggaccctacgggtaacccgtttaccggtccgggttaacgggttccgtacccgttacgttacccggtgggtaccgggtccgggtacggttaccgggaccggtaccggggtcccgtacgtaaggtccgtctacggctaacggcttagc

SEQ ID NO: 147441 - DNA, 751 bp, Homo sapiens
  misc_feature: GYAE6OF02FRQVS.3.23.C01.1.454.CMB.1.raw
  modified_base (203)..(203): a, c, t, g, unknown or other
  misc_feature (203)..(203): n is a, c, g, or t
tcagagacgcactccacgaccggtgctcgatttagtacacgtgattagggattggggagagctgctcagttaggacccagagggaaccatggaaaccccagcgcagcttctcttcctcctgctactctggctcccagactacccccggagaaatttcgttttgacgcagtctccaggccaccctgtctttgtctcgagggganagacgccacctctcctgcagggccagtccgagtcgtcagcacgcaacctacttacgccgtaggtacccaagtcaagacgaccgtacggcctaacggccttacccgaaggtccttcccgtacctaactcccaagttcgggtacgacctaacgtacccgaaacggtacgggacccctacgttcgggacctacgttaccccggaagtaccgtaggttcaacggttggaccagggttcgggtactacggaacgtacgtacttacgtacctctaccgaaccgatacggagtaccgacgtaccgtgggaacgtcgttaagtaaacgttcgtttacgactttaaggtttaactcgttcgtacgtacgtacgtaaggttacgttacggttacttaccttacgtttacgtttacgggtaccttaaggttttcccgggaacggggtaccgggtaaaccggttacgggtacggtaacggtaaccgtaaaccggtaaaccggtaacgtttcgggacgttacggtcggtaaccgaaccgttacgttaccgttcgttaaccg

SEQ ID NO: 147442 - DNA, 830 bp, Homo sapiens
  misc_feature: GYAE6OF02HMCJH.3.23.C01.1.454.CMB.1.raw
  modified_base (820)..(820): a, c, t, g, unknown or other
  misc_feature (820)..(820): n is a, c, g, or t
tcagagacgcactccacgaccggtgctcgatttagtacacgtgattagggattggggcctcagtgaaggtctcctgcaaggcgtctggatacgacgtcagcaggaggtatagtacactgggtgcgacacggcccctggacaacggccttgacgtggatgggaataactccaaacccgtagtgagtggtggacacaagctaacgcaaaccgagttccgagggaccagacgtccaccgtatgtaccgaacgggactaccggacccggtacgaaaccacgtaacggtcctaagttttacggaaacgtggtaaagtaagtttacgaaacgttcgtaggaccgaaccgtacgggtaccttaggttacgtttaaccgttggtaccggaccggtaaggtaacctaacgtcgttacggtccggtaccggttcgtaaccggtgtacccgttacggttccggttaacggtttccgggtacggggacccgtaacgggtcccgtacggttaccgaccccgtttcttcccgtacgacctccccgtacccgaaccggaccggtcccgtaacggttccccggttaccccgttaccccggtccgtacccgtacccccgtacccgtacccgaacggtacccgaccgtacccggtccggtaccggggaaccgacccggaccggtccgggtcccgggtcggtacccggtccggtccggtaccggtaccgggtaacccgtaaccgttaacccggttaccggtcggttaccgtccgttaccgtcggtaccgggcggtccgggtcggtacgggaccggtaggtacccggagtacgtacgagngtcgagcgag

SEQ ID NO: 147443 - DNA, 222 bp, Homo sapiens
  misc_feature: GYAE6OF01CLC4G.21.86.H09.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 147444 - DNA, 222 bp, Homo sapiens; identical to SEQ ID NO: 147443
  misc_feature: GYAE6OF01CLF8H.21.86.H09.1.454.CMB.1.raw
  modified_base (220)..(222): a, c, t, g, unknown or other
  misc_feature (220)..(222): n is a, c, g, or t

SEQ ID NO: 147445 - DNA, 223 bp, Homo sapiens
  misc_feature: GYAE6OF01EY57M.21.86.H09.1.454.CMB.1.raw
  modified_base (220)..(223): a, c, t, g, unknown or other
  misc_feature (220)..(223): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnn

SEQ ID NO: 147446 - DNA, 221 bp, Homo sapiens
  misc_feature: GYAE6OF01DRJ2U.21.86.H09.1.454.CMB.1.raw
  modified_base (220)..(221): a, c, t, g, unknown or other
  misc_feature (220)..(221): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnn

SEQ ID NO: 147447 - DNA, 222 bp, Homo sapiens; identical to SEQ ID NO: 147443
  misc_feature: GYAE6OF01CJW38.21.86.H09.1.454.CMB.1.raw
  modified_base (220)..(222): a, c, t, g, unknown or other
  misc_feature (220)..(222): n is a, c, g, or t

SEQ ID NO: 147448 - DNA, 222 bp, Homo sapiens
  misc_feature: GYAE6OF01A9DSB.21.86.H09.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnn

SEQ ID NO: 147449 - DNA, 222 bp, Homo sapiens
  misc_feature: GYAE6OF01C2ORO.21.86.H09.1.454.CMB.1.raw
  modified_base (219)..(222): a, c, t, g, unknown or other
  misc_feature (219)..(222): n is a, c, g, or t
tcagtcgtcgctcgcacgaccggtgctcgatttagtgctatagacttgggtttgggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnn

SEQ ID NO: 147450 - DNA, 221 bp, Homo sapiens; identical to SEQ ID NO: 147446
  misc_feature: GYAE6OF01D8XMY.21.86.H09.1.454.CMB.1.raw
  modified_base (220)..(221): a, c, t, g, unknown or other
  misc_feature (220)..(221): n is a, c, g, or t

SEQ ID NO: 147451 - DNA, 222 bp, Homo sapiens; identical to SEQ ID NO: 147443
  misc_feature: GYAE6OF01DU45B.21.86.H09.1.454.CMB.1.raw
  modified_base (220)..(222): a, c, t, g, unknown or other
  misc_feature (220)..(222): n is a, c, g, or t

SEQ ID NO: 147452 - DNA, 247 bp, Homo sapiens
  misc_feature: GYAE6OF01DLA3W.21.86.H09.1.454.CMB.1.raw
  modified_base (220)..(247): a, c, t, g, unknown or other
  misc_feature (220)..(247): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnnnnnnnnnnnnnnnnnnnnnn

SEQ ID NO: 147453 - DNA, 529 bp, Homo sapiens
  misc_feature: GYAE6OF01CQ9OQ.21.86.H09.1.454.CMB.1.raw
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatcagctgcagcagtccggtcaggactggtgaacgccctcgcacgaccctctcactcacctgcgacatcgccgggganagtatcttancacctatagtacttggaattggatcgaggcagtccccgtgagacggccttgagtggcgtagggaagcattctaacgaggtccaagtagtggtattcgtagtaattatgctaggtgtcgtgtagagtaagtcgaagtggacagtcactacacgacccaacgaagtactctagttcctcccgtgactattcgctacgttctagtcaccgtcccgacgtaccg

SEQ ID NO: 147454 - DNA, 224 bp, Homo sapiens
  misc_feature: GYAE6OF01ED99D.21.86.H09.1.454.CMB.1.raw
  modified_base (220)..(224): a, c, t, g, unknown or other
  misc_feature (220)..(224): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnn

SEQ ID NO: 147455 - DNA, 223 bp, Homo sapiens
  misc_feature: GYAE6OF01E5ZH2.21.86.H09.1.454.CMB.1.raw
  modified_base (219)..(223): a, c, t, g, unknown or other
  misc_feature (219)..(223): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcggctggcaaggcgcatagnnnnn

SEQ ID NO: 147456 - DNA, 666 bp, Homo sapiens
  misc_feature: GYAE6OF01BXAHC.21.86.H09.1.454.CMB.1.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtctcctgtcgacaaatcagctgcagcagtccgtcaggactggtgaacgccctcgcagaccctctcactcacctgcgacagtcgtccggganagtatctttancaccatagtactgaattggatcgagcacgtcccgtagagacgcttggagtggcgtagggaacgactattcaacgagtccagtagttggtacttcgtagtattagtgcgtaggttcgtacgttaggtacggtaaggtaaacggttacggtaaagttacgggtaacctaacgttacccgaaaccgttaaaccgaaacccggtaaaccccgaaaccggtaaaaacgtaaaccgttaccgttaaaccgttttcccgtaccccgttacggtaacccgttactttttaccgggacctttaccggttaccgttacggttaccggtaacccccgttaccccgggtaaaccggtaaacccggg

SEQ ID NO: 147457 - DNA, 223 bp, Homo sapiens; identical to SEQ ID NO: 147445
  misc_feature: GYAE6OF01AICPY.21.86.H09.1.454.CMB.1.raw
  modified_base (220)..(223): a, c, t, g, unknown or other
  misc_feature (220)..(223): n is a, c, g, or t

SEQ ID NO: 147458 - DNA, 642 bp, Homo sapiens
  misc_feature: GYAE6OF01DDF8Z.21.86.H09.1.454.CMB.1.raw
  modified_base (212)..(212): a, c, t, g, unknown or other
  misc_feature (212)..(212): n is a, c, g, or t
  modified_base (317)..(317): a, c, t, g, unknown or other
  misc_feature (317)..(317): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtntcctgtcgcaaatacagctgcagcagtccggtccaggactggtgaacgccctcgcacgaccctctcactcacctgcgacactcgtccggggatagtactctttanccacctactagtacttgaattggatcgaggcacgtccccgtagagacggtcgttggagtcggcgtagggaaacgtactacgttcgtaaccgaggtacccgaagtagttgggttaactttcgtagtactttaagtcgacgtagttgtccgttaggtagtaaggtaagtacggtaaagtgggaacctagttaccaacttaacgaacccgaaccccgaaccgaaagtacctaccgtaaagtttccccgtacccgtcggtaccttacggtttaccgaccttaccgttaccgttaggtacccgtaacccgtccccggaacggtaacccgg

SEQ ID NO: 147459 - DNA, 224 bp, Homo sapiens; identical to SEQ ID NO: 147454
  misc_feature: GYAE6OF01CPTJ9.21.86.H09.1.454.CMB.1.raw
  modified_base (220)..(224): a, c, t, g, unknown or other
  misc_feature (220)..(224): n is a, c, g, or t

SEQ ID NO: 147460 - DNA, 667 bp, Homo sapiens
  misc_feature: GYAE6OF01DDWOZ.21.86.H09.1.454.CMB.1.raw
  modified_base (211)..(211): a, c, t, g, unknown or other
  misc_feature (211)..(211): n is a, c, g, or t
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccatggggtntcctgtcgcaaatcagctgcagcacggtccggtccaggacctggtacgaacgccctcgcacgaccctctccactcacctgcgacagtccgtcggggatagttacttctttanccacctacttagtacttaggaattggatcgaggcacggtcccgngagacggtccttggacgtggcgtaggggaacgtactagtttaccgaacgtacggtaccctaagtacgttgggttaactttcgtagtaactttagcgtactaggttcgttcgttagggtagtaaggtaacgggttcgtaaacgttcgggaacctacgttaccgaaacttaaccgaaccgtaccccgtaaacggtaaagtaacgtacccgttacgtttacccgtaccccgtagtaccgtttaacgtttcgacccttaaccgttccgtacggttaccgaaccccgttcccggaaccgtaccgg

SEQ ID NO: 147461 - DNA, 746 bp, Homo sapiens
  misc_feature: GYAE6OF01DGSRO.21.86.H09.1.454.CMB.1.raw
  modified_base (184)..(184): a, c, t, g, unknown or other
  misc_feature (184)..(184): n is a, c, g, or t
  modified_base (514)..(514): a, c, t, g, unknown or other
  misc_feature (514)..(514): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttccngcccgtactcgggcctccagtcggggtcgtcctgtcgacaaatcagctgcagcacggtccggtccaggtactggtgacgccctcgcacgaccctctccactccacctgccgacacgtccgtaccggggagtacgttacttctttaactccaacctaacgttaacgtacgtttaggaaagtttggaactcgaggtcctaccggtccccggtacggaggtaccggtccgttaggtacggtcgggtacggtaggggaacgtaaccgtacgtttaccgtaacgacgggttacccaaggttacgtttacggttaatttccgtagttaactttacngggtccgtaaggttcgtcgttaggacgtaaggtaacggttacgaaagttcgggaactacgtaccaaccgttaacgaacccggtaaccccgaaacgggtaaaacttacgtaccgttaccgttaccccgttaccgttaggttaacctttacggttttaccggaccctttaacccgggttctttaccgggttaaccctaaccccggttaaccccccgggtaaacggtaacccggg

SEQ ID NO: 147462 - DNA, 540 bp, Homo sapiens
  misc_feature: GYAE6OF01ECCEU.21.86.H09.1.454.CMB.1.raw
  modified_base (316)..(316): a, c, t, g, unknown or other
  misc_feature (316)..(316): n is a, c, g, or t
  modified_base (389)..(389): a, c, t, g, unknown or other
  misc_feature (389)..(389): n is a, c, g, or t
  modified_base (453)..(453): a, c, t, g, unknown or other
  misc_feature (453)..(453): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtccggtccaggactggtgaagccctcgcagaccctctcactcacctgcgacagtccgtccggggagacgttatcctttanccaccatagtacttggaattggatcaggcacgtccccgtgagacggccttgagtggcgtgggaagcagttcanaggtccagtagttggtattcgtgtattagtgcagttgtctggtgagaagtcgaagttcggaacntacaactacgacaccccgaagagaatcaagtttccctcccgtgcctagtttcgacctacgttctaggtacacctccccgagtacccg

SEQ ID NO: 147463 - DNA, 565 bp, Homo sapiens
  misc_feature: GYAE6OF01AD0DZ.21.86.H09.1.454.CMB.1.raw
  modified_base (227)..(228): a, c, t, g, unknown or other
  misc_feature (227)..(228): n is a, c, g, or t
  modified_base (230)..(232): a, c, t, g, unknown or other
  misc_feature (230)..(232): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
tcagtcgtcgctcgcacgaccggtgctcgatttagtgctatagacttgggggtttggggccagggaaccctagtcaccgtctcctcagcctccaccaagggcccactcggtcttcccctggcgcctgctccaggagcacctccggagacgcgacagcggccctgggctgcctggtcaaggctacttccctcgtctctactgacgcgggctggcaaggcgacatacgnncnnncgntngantntatgtantgtncnganaacttacncgcnacactcatctcnctntncncgtactactacncgactgtacgtcgtactacncgtagtagcgtgagtctacgagtacgacncgttacctacgtactacactacggtacncgtacgtacgtcgtcgtacgtacgacgtacgtacgtacgtagtacgtagtacgtacgtacgtacgacgtacgacgtacgtacgtacgtacgtacgtacgtacgtacgtacgacgtacgtacgacgtacgaacgaacgtacgtacgtacgtcgtacgtacgtaccgtacgtacgactactcgtcgtcg

SEQ ID NO: 147464 - DNA, 586 bp, Homo sapiens
  misc_feature: GYAE6OF01A0XJF.21.86.H09.1.454.CMB.1.raw
  modified_base (211)..(211): a, c, t, g, unknown or other
  misc_feature (211)..(211): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtntcctgtcgcaaatcagctgcagcagtccggtccaggactggtgaacgccctgcagaccctctcactcacctgcgacagtccgtccgggganagtattctttancaccatagtacttggaattggatcgaggcacgtccccgtgagacggccttgagtggactgggaagcagttctacaggtccagtatggtattcgtgtattagtcgctaggtgtcgtggtacgaagtaacgtcgtaaagtcgggaactagtaccgtaacgtaacgaaccgaaccccgaaccgtaaagtaactccgtaacgttccgtcccgtaggaccttagtttccgaccttaaccttccgttaggttaccgacccttccccggaacgtacccg

SEQ ID NO: 147465 - DNA, 653 bp, Homo sapiens
  misc_feature: GYAE6OF01DHCQS.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtgtcctgtctacaaatacagctgcagcagtccgtccaggactggtgaacgccctcgcacgaccccttctcactccacctgccgactacgtccgtaccggggatacggtaattcctttatccaccgtacttagttacgttaggaactttggactcgacggctaccgtcccccggtaggacggtacggtccgttggacggtcgggcgtaggggaaaggtacctagtttctaacgaggtaccctaagtacgtaggttattcgtaggtaacttagtcgtacgtagtcgttacgtggtagaaggtaagtacgaagtggaactagtaccaacgtaacgtaaccgaccccgaacgtaacggtaaactccgtacgttcccgtacccgttacgtacgttacttcgtacctaccgttccgtagtacccgtacccgtacccggacgtaacccgg

SEQ ID NO: 147466 - DNA, 224 bp, Homo sapiens; identical to SEQ ID NO: 147454
  misc_feature: GYAE6OF01C0A67.21.86.H09.1.454.CMB.1.raw
  modified_base (220)..(224): a, c, t, g, unknown or other
  misc_feature (220)..(224): n is a, c, g, or t

SEQ ID NO: 147467 - DNA, 223 bp, Homo sapiens; identical to SEQ ID NO: 147445
  misc_feature: GYAE6OF01AI0YJ.21.86.H09.1.454.CMB.1.raw
  modified_base (220)..(223): a, c, t, g, unknown or other
  misc_feature (220)..(223): n is a, c, g, or t

SEQ ID NO: 147468 - DNA, 650 bp, Homo sapiens
  misc_feature: GYAE6OF01BC1UX.21.86.H09.1.454.CMB.1.raw
  modified_base (212)..(212): a, c, t, g, unknown or other
  misc_feature (212)..(212): n is a, c, g, or t
  modified_base (318)..(318): a, c, t, g, unknown or other
  misc_feature (318)..(318): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccagtggggtntcctgtcgacaaatacagctgcagcagtccggtccaggactggtgaacgccctcgcacgaccctctcactcacctgcgacatcgtccggggagtacgtatctttancaaccactagtacttggaattggactcgaggcacggtccccgtagagacggtccttggaggtggccgttagggggaaacgtactagttaccgtaacggacggttaccaaggtagtttgggttaatttccgtagttaatttagttcggacgtaggttgttacgttggtacggaaggtaaaggtacggtaaagttcgggaacctaagttacccgtaaacgtacgaacccgtaaccccgaaccggtaaagtaacttccgtaacgtttcctccccgtagaccttagttccacttaccgttcgtacggttaccgaaccctcccggaaccgtaaccgg

SEQ ID NO: 147469 - DNA, 593 bp, Homo sapiens
  misc_feature: GYAE6OF01D8ER6.21.86.H09.1.454.CMB.1.raw
  modified_base (210)..(210): a, c, t, g, unknown or other
  misc_feature (210)..(210): n is a, c, g, or t
  modified_base (318)..(318): a, c, t, g, unknown or other
  misc_feature (318)..(318): n is a, c, g, or t
  modified_base (443)..(443): a, c, t, g, unknown or other
  misc_feature (443)..(443): n is a, c, g, or t
  modified_base (528)..(528): a, c, t, g, unknown or other
  misc_feature (528)..(528): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtactccttcctcatcttcctgcccgtactgggcctccagtggggtntcctgtcgcaaatcagctgcagcagtccggtcaggactggtagacgccctcgcacgaccctctcacttcacctgccgacatccgtccggggatacgttattctttacnccacctactagtacttaggaattcggatcgaggcctacgtccccgtgagaggtccttggacgtcggcgtaggggaacgtactaagtttcaacgacggtccaagtattgggtattcgagtattagngacgtagtgtcttaggtggaagtacgtcgtaaagtcggaactatcgactacgacgaacccaacggaataactccgtaagtttccnccgtaggtacttagtttcgccttaaccgtttcgttaacgacccttccccgaaagtcccgtaacgg

SEQ ID NO: 147470 - DNA, 224 bp, Homo sapiens; identical to SEQ ID NO: 147454
  misc_feature: GYAE6OF01BK55A.21.86.H09.1.454.CMB.1.raw
  modified_base (220)..(224): a, c, t, g, unknown or other
  misc_feature (220)..(224): n is a, c, g, or t

SEQ ID NO: 147471 - DNA, 703 bp, Homo sapiens
  misc_feature: GYAE6OF01ADHLB.21.86.H09.1.454.CMB.1.raw
  modified_base (213)..(213): a, c, t, g, unknown or other
  misc_feature (213)..(213): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgcccgtactcgggccctcccgagtggggtntcctgtcgacaaatcagctgcagcacggtccggtaccgaggacgtggtacgaacgccctacgccacgacccctctaccacctccacctgaccgactacgtccggtaccggggatacgttacttcttttaacacctaaccctaacgttacgttaaccgtttaggtaatttcgggaacttccggaacggtccgtaccgggttcccccggtaggaacggtacggtccgtttagggacggttcgggacgtaggggaactaccgtagttaccgtacgacggtaccgaaggtagttacggttattccgtagtagtttacgcgtacgtagttcgtcgtggtacgaaggtaacgtaggtaagtacgactagtaccaaccgtacgaccgaacccgaacgtaaactacgttaccgtaccgttcccgtaccgtacgtacctttcgttaccgacttaccgttacgttacgtacccggtacccctacccggacggtaacccgg

SEQ ID NO: 147472 - DNA, 746 bp, Homo sapiens
  misc_feature: GYAE6OF01B0Q67.21.86.H09.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccagtggggtgtcctgtcgcaaatacagctgcagcagtccggtcaggactggtgaagccctcgcacgaccctctcactcacctgcgacatcgtaccgggganacgtatctttatcaccactagtacttggaattggatcaggctacgtcccgtcgagcggtccttggagtcgggcgtaggggaacggtactagtttaccgtaacgtacgggttaccaagggtacgttacgggttactttacgtaggttaacgtttaagtcggtacgtaaggttcggttacgttaggtacggtaagggtaacggtacggtaaaggttacgggaacctaacgttaccgtaaaccgtttaaccgaaaccgggtaaccccccgtaaaaccgggtaaaacggtaaaaccgttacccggttaaaccggttttaccccgttaccccgtttacggttaacccgttaaccggtttttccggaaccctttaacccggtttcctttacgggttaacccggttaacccccggttaaccccccgggtaaaccggttaaacccccgggg

SEQ ID NO: 147473 - DNA, 732 bp, Homo sapiens
  misc_feature: GYAE6OF01C90O4.21.86.H09.1.454.CMB.1.raw
  modified_base (98)..(98): a, c, t, g, unknown or other
  misc_feature (98)..(98): n is a, c, g, or t
  modified_base (299)..(299): a, c, t, g, unknown or other
  misc_feature (299)..(299): n is a, c, g, or t
tcagtcgtcgctcgcacgaccggtgctcgatttagtgctatagacttgggtttgggggccagggtgtggtttcctgtttaaatgtagccctcccccgntgcagaattgcagagcctgctgaattctggctgaccagggcagtcaccagagctccagacaatgtctgtccttccttcctcattccttcctgcccgtatcgggccctccgaggtggggtctcctgtcgacaaatcagctgcagctacggtccggtcgaggtcgtggtcgaacgccctcgacaccgtaccctctacctaccncctaccgtcgaccgtaacctcggtaccggtaccgggaagtacgttacttcctttacaccctaaccgtacgtttagttacgttaggaacttcggactacggacggtaccgtaccggtccccgtaggaacgtcgtccgttggaggtcggacggttaggggaaacgtactacgttaccgtaacgacggtaccgtaagttagttacggtttactttacggttagtaacgtttaggcgttacgtaaggtttcgtacgttaggtaacggtaaggtaacggttacgtaagtacggaactacgtaccgtaaaccgtacgaaacccgtaccgtaacggaaagttactacccgttacgttaccccgtacgtacgtaacgtttcgttaccgtacgttaccgttaccgtacgtacccggtaaccccgtacgggaccgtaacccgg

SEQ ID NO: 147474 - DNA, 684 bp, Homo sapiens
  misc_feature: GYAE6OF01BKJ76.21.86.H09.1.454.CMB.1.raw
  modified_base (521)..(521): a, c, t, g, unknown or other
  misc_feature (521)..(521): n is a, c, g, or t
  modified_base (546)..(546): a, c, t, g, unknown or other
  misc_feature (546)..(546): n is a, c, g, or t
  modified_base (683)..(683): a, c, t, g, unknown or other
  misc_feature (683)..(683): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgattctggctgaccagggcagtcaccagagctccagacaatgtctgtctccttcctcattccttcctcgcccgtactcgggccctcccagttggggtcttcctgtcgacaaattcagctagcagcacggttccggcaaggtactggtcgaacgcccctgaccacgaccctcctactaccgtcaccgtggacgtacctacgtccggtaccgggggaactacggttaacctttacttttaactaccgaacctaacgtttacggttaaaccgtttaggtaaaccgttttgggaacttccgaacggtcccgtaaccgttacccccggtaggacggtacggtaccgttggacgggttcgggaccggttaagggaacgtaactacggttacctacggtaacggttaccngtacgtagtattcgagtatagtcgngttagtcgtgtaggtagtagaaccgttagaagtaccgtaactacgtactaaccgtacgaaccgaacccgaacgaagtactactaccgttctccgtctaagtcttactacacgtttcgactaccggaccctcggaacnc

SEQ ID NO: 147475 - DNA, 661 bp, Homo sapiens
  misc_feature: GYAE6OF01DDZ4H.21.86.H09.1.454.CMB.1.raw
  modified_base (366)..(366): a, c, t, g, unknown or other
  misc_feature (366)..(366): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggccctccagtggggtgtcctgtcgacaaatcagctgcagcacgtccggtaccaggactggtcgaacgccctcgcacgaccctctcactcacctgcgacacgtccgtacggggatagtactcttagtacacctacttacgtacttggaattggatcgaggcacgtccccgngagacgtctgagtcggacgtaggaacgactacttacgtacgtacggccagtacgtggttacttcgtagtaacttagtcgtacgtaggttcgacgttaggtggtaacggtaagttacggtaaagtcggaactacgttaccgaaacgttaaccgaaccgtaaccccgaaaccggtaaacgtaacgttaccgttacggttaccctttacccgtaggttaccttaacgtttccggtaccgttaccgttaccgttacggtacccggttaacccgtacccccgggtaaccgtaaaccccgg

SEQ ID NO: 147476 - DNA, 225 bp, Homo sapiens
  misc_feature: GYAE6OF01BU2NA.21.86.H09.1.454.CMB.1.raw
  modified_base (220)..(225): a, c, t, g, unknown or other
  misc_feature (220)..(225): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnn

SEQ ID NO: 147477 - DNA, 694 bp, Homo sapiens
  misc_feature: GYAE6OF01DUAHD.21.86.H09.1.454.CMB.1.raw
  modified_base (185)..(185): a, c, t, g, unknown or other
  misc_feature (185)..(185): n is a, c, g, or t
  modified_base (496)..(496): a, c, t, g, unknown or other
  misc_feature (496)..(496): n is a, c, g, or t
  modified_base (625)..(625): a, c, t, g, unknown or other
  misc_feature (625)..(625): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacatgtctgtcctccttcctcattccttccncgtcccgtacgtcgggccctccgtggttcggggtctccgtgtcgactaaatacagtctgcacgtcgacgtccgtacgaggtcgtggtacgaacgtccctcggacctaccgtaccctctaccacctccaccgtcgccgtactacgtccggacgggtatacgttacttacttactaccaactacgtaacgttacgttagtagtcgactcgacgtcgtacgtcccgtagacgtacgtcgtagacggtacgacggtacggacgtactacgttacgtacgacgttagagttagttagttagttgtagtagttacgnggggttaccttggtaccgtggaacggtacgtaaggtaccgtaagtcggtaactccgtaacgttacccgaaaccgaccgtaacccgtaacggtaagttccgttaacctccggtttaccctacccggttanactttaaccgttcgaacccttctacggttccgaactacccccgggtaccgtaacgtcccgggttacccg

SEQ ID NO: 147478 - DNA, 663 bp, Homo sapiens
  misc_feature: GYAE6OF01BKSL8.21.86.H09.1.454.CMB.1.raw
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtntcctgtcgcaaatacagctgcagcagtccggtcaggactggtgaacgccctcgcacgaccctctcactcacctgcgacatcgtcgggangtatcttancacatagtacttggaattggatcacggcacggtccccgtgacgtaggccttggagtggcgtaggggaacgactagttctacgaggtccagtagtggtattcgtagtatttacgtcgactacggttacgttcgttaggtggtaaggtaagtacggtaaagtacgggtaacctacgtaccgtaaaccgttaccgaaccggaaacccccgtaaaccggtaaacgtaaaccgttaccgtaaaccggttttcccgtaccccgttacggtacccgtttaacgtttccgtacccgttaacccgtttaccgttacggttacccgtaacccggttacccccggtaaccgggttaaacccccgg

SEQ ID NO: 147479 - DNA, 749 bp, Homo sapiens
  misc_feature: GYAE6OF01EJWNB.21.86.H09.1.454.CMB.1.raw
  modified_base (296)..(296): a, c, t, g, unknown or other
  misc_feature (296)..(296): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccgagtggggtgtcctgtcgacaaataccagctgcagcacgtccggtcaggactggtgaacgccctcgcacgaccctctcactccacctgccgtanactcggtaccggggagtacgttattcgtttacacctacctacgttagttacgttaggtaatttcggatcgacggccgtaacggttccccggtacgaagggtacggttccgtttacggacggttcgggccgttagggggaaaacgggtcccttaaacgtttccgttaacccggaacgggtttacccgaaggttaacgtttacggggtttatttccgttaaggttaatttaacgttgggaccgttaggttcgttacggttaggttagggtaaggtaaacggttacggtaacgtttacggggaactacgtaaccgtaaccgttaaccgaacggaaccccgtaaacggaaacggtaaacttccgttaacgtttccctacccggttagtaccgttacgttttacgaccttaaccgttcgttacgtacccgtaaccgttaccccggaccggtaacccgg

SEQ ID NO: 147480 - DNA, 626 bp, Homo sapiens
  misc_feature: GYAE6OF01A74S9.21.86.H09.1.454.CMB.1.raw
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccagtggggtcgtcctgtcgacaaatcagctgcagcacgtccggtccaggactggtgaacgccctcgcacgaccctctcactcacctgacgacactccggtccgggatacgttatctttacnccacctactagtacttggaattgatcagcacgtcccgtgagaggtcctggngtggcgtagggaacgtactagttacacgtaggtccagtattggttattcgtagtattagcgtcgtaggtgttacgtggtacgtaaggtaacgtacggtaagtacgggactaacgtaccgtaacgtaccgaaccgtaaccccgaacgaaacgtaactccgttacggttcccgtacccgttagaccgtttacgtttaccgaccttaccgttacggttagtaccccgtacccgttaccccggaaccggtacccgg

SEQ ID NO: 147481 - DNA, 229 bp, Homo sapiens
  misc_feature: GYAE6OF01DBCXI.21.86.H09.1.454.CMB.1.raw
  modified_base (220)..(229): a, c, t, g, unknown or other
  misc_feature (220)..(229): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnnnn

SEQ ID NO: 147482 - DNA, 220 bp, Homo sapiens
  misc_feature: GYAE6OF01BIEJC.21.86.H09.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagn

SEQ ID NO: 147483 - DNA, 222 bp, Homo sapiens
  misc_feature: GYAE6OF01CGKNF.21.86.H09.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtgctatagacttgggtttggggccagggaaccctagtcaccgtctcctcagcctccaccaagggcccatcggtcttccccctggcgccctgctccaggagcacctccgagagcacagcggccctgggctgcctggtcaaggctacttcccgagcgacgactgagcgggctggcaaggcgcatagnnn

SEQ ID NO: 147484 - DNA, 614 bp, Homo sapiens
  misc_feature: GYAE6OF01D3PFJ.21.86.H09.1.454.CMB.1.raw
  modified_base (459)..(459): a, c, t, g, unknown or other
  misc_feature (459)..(459): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccaggggcagtcaccagagctccagacaatgtctgtcctccttcctcatcttcctgcccgtactcgggcctccagtggggtctcctgtcgacaaatcagctgcagcacgtccggtccaggtactggtagaacgccctcgcacgaccctctcactccacctgcgacagtccgtccggggatagtacttctttactccaacctagtagttacttggaattcggaatcgaggccacgtccccgtagacgtacggtccttggaggtcggacgtagggaacgtactactttacgacgtacggtaccaggtagttggttattacgtgtattagngtctaggttcgttagtgtaggaagtaacgtacgaacgttggactactacctaacgtacgaaccgaacccgaacgtaaagtactacgtacgtttccctccttacgtctactttcgacctacgttctacggtacctacccgtcccgaacgtacccgg

SEQ ID NO: 147485 - DNA, 583 bp, Homo sapiens
  misc_feature: GYAE6OF01BNOD3.21.86.H09.1.454.CMB.1.raw
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtgtcctgtcgacaaatacagctgcagcagtccggtccaggactggtgaacgccctcgcacgaccctctcactcacctgccgacatcgtccgggganagtatctttacncacctactagtacttggaattggatcgaggcacgtccccgtgagacggtccttgagtggcgtagggaagactattacacgaggtaccagtagttggtattcgtagtattagtgtacgtagtgtcgtagtgtaagaaggttcgaagtgggaactataccgaactaccgacgaacccgaacgaagtaactcgtaacgttcctccccgtagtccgttacgttcgcctaaccgttcgtacgtacgacccgttcccgaacccggtaacccg

SEQ ID NO: 147486 - DNA, 228 bp, Homo sapiens
  misc_feature: GYAE6OF01C6LLM.21.86.H09.1.454.CMB.1.raw
  modified_base (221)..(228): a, c, t, g, unknown or other
  misc_feature (221)..(228): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaacggactacttcccgagcgacgactgagcgggctggcaaggcgcatagnnnnnnnn

SEQ ID NO: 147487 - DNA, 830 bp, Homo sapiens
  misc_feature: GYAE6OF01BHNR9.21.86.H09.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagtgctatagacttgggtttgggggccagggtgtggtttcctgtttaaatgtagccctcccccgctgcagaattgcagagcctgctgaattctggctgaccagggcagtcacagagctccagacaatgtctgtcctccttcctcattccttcctcggccccgttacgtcgggccctcccgagttcggggtcgtcccgtgtcgacaaaatcagctgcagcacgtccggtacgaggtactggtcgaacgtcccgtcgacacgtaccctctaccacttccacccgtgaccgtacgtacgtccggaccggggatacgttacttcgtttacnccctaactacgttacgttacgttaggtaacgttcggtacttacgggacgaccgtacccggttccccggtaggaacggtaccggttcggttaacggacgggtacgggtaccgggtaacggggtaaaacggtcttaacgtttaccggtaacggtacccgggtactaggggttaaacgtttcgggttaaacgtttacgtaacgggttaactttacgtaccgggtacgtttaacgggttcggttaattacggggttaaggtaaccggtaaaagttaccggaaggttacggaacccttacgtaacccgtaacccggtaaacgaaccccggtaaaccgaaacccggttaaacgtaccggtaaccccgttaccgtttacccggtaccctttagggtaactttaccgtttaccggtaccctaaccgtttccgttaacggacccgttaaacccccgggtccgtaaacccgggtacccgg

SEQ ID NO: 147488 - DNA, 830 bp, Homo sapiens
  misc_feature: GYAE6OF01BBD8V.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctcagacaatgtctgtctccttcctcatccttcctgcccgtagtgggccctcccaggtggggtctcctgtcgacaaatacagctgccagtccacggttcccggtaccaggacgtggtacgaaccggtcccctacggacctaaccggtacccccttcctacctaccgttacccgtacccgttcggacccgtaaccgtacggttccccgggtaaccggggggggtacgttaaacggttttacctttacctttttaaccgaccctaacccgttaaaccgtttaacggtttaaccgtttagggtaaaacgttttcgggaacttacggacggtaccgtaccggttcccccggtaaggacggtacggtccgtttagggacggttcgggacggttagggggaaacgtacgtaacgtttaccgtaggaaccgggtacctaaggtacgttggttaactttcgtagtatttagcggttacgtaggttcgttaggtcggtaaggtaacggtaacggtacggtaagtacgggtaacctacgtaccgaaccgttaacgaacccggaacccgaacggtaaacgttactaaccgttccgtttaaccccgttaccgttagtacgtttaacccgttttcgaaccttaccgtttacggttaccggtacgttacccccgggcccgtaaaggtaccccggg

SEQ ID NO: 147489 - DNA, 670 bp, Homo sapiens
  misc_feature: GYAE6OF01BNRTR.21.86.H09.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaattgtctcgtcctccttcctcattccttcctcgcccgttacgtcggggccctcccgtaggttcggggttctccgttcgtccggacaaaacgttccagcctgccaagccgtacggtcccggtaccgaggacgtggtcgaaccgcccgtcgacaccgtaccctctcactccactcgcgacacgtccggacgggagtacgtacttcgttacncctactacgttagtacgtaggtaattcggactcgacggtcgtaccgtcccgtaggacgtcggtccgttggacggtcggacggtaggaacgtactacgttaccgtacgtacggtcaaggtcgttagttacttacgtataagttcgagtagtaggttgtacgtaggtacgacgtagtactaagacggtactagtacccgaatacggaacccgaaccgaacgtaacgtcttcgtaacccgttcctaccggagtaccttcgttccacgttcctcggttacgaccccgtaacctccgggaacgtaccg

SEQ ID NO: 147490 - DNA, 696 bp, Homo sapiens
  misc_feature: GYAE6OF01D1VPW.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtctcctgtcgacaaatacagctgcagcacgtccggtccaggtactggtcgaacgcccctgcacgaccctctcactcacctgccgacagtccggccggggatagttacttcgtttatccaacctattacgttacttggtaacttggactcgaggcctacggtccccgtaggagtacggtccgttggacggtcgggacgttacggggaaacgtactaactttcgtaacgtacggtaccgaaggtagttggttacttcgtagttagttaacgtgacgttcggtagttcgtaggtacggaagtaaggtacggtaaagttacgggtactaacgtactaacgttaaccgaacgtaaccccgtaaacggtaaacgtaacttaccggttaccgtttacccgtacccggtttactaaccgttcgtttaaccgtcccgttaacgtttccgtacggttaccggtaacccccgttacccggtaacccgtaaaccccggg

SEQ ID NO: 147491 - DNA, 781 bp, Homo sapiens
  misc_feature: GYAE6OF01DPVDV.21.86.H09.1.454.CMB.1.raw
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgcccgttactcgggcctccagtcggggtctcctgtcgacaaatcagctgcagcagtccgtcaggctggtanaacgccctcgcacgaccctctcactcactgccgacagtccgtacggggatacgttactactttanacctacctaacttagtacgttaggaactttggacttcgacggtccgacggttcccccggtaggacggtacggtccgttaggacggtcggggtaccgtaagggggaaacggtaccttaagtttaccgtaaccggtaacgggtaccccgtaaggtaccgtttaggggtttaacgttttaccgttaagttaacgtttacgttacggtaccgttaaggtttcggttacgtttacgggttacggtaacggtaacggttacggtaaacggttcggtaaaccgtacttacccgtaaaccgttaacccgtaacccggaaccccgtaaacgggtaaaaccggttaaaccgtaccggttaacccgtttccccgttacccggttaggtaccctttaacggtttacgaaccctttaaccgttccgttaacggttacccgtaaccccggttaccccggtaacggttaaccccggg

SEQ ID NO: 147492 - DNA, 659 bp, Homo sapiens
  misc_feature: GYAE6OF01A43YE.21.86.H09.1.454.CMB.1.raw
  modified_base (451)..(451): a, c, t, g, unknown or other
  misc_feature (451)..(451): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
  modified_base (612)..(612): a, c, t, g, unknown or other
  misc_feature (612)..(612): n is a, c, g, or t
tcagtcgtcgctcgcacgaccggtgctcgatttagtgctatagacttgggtttgggggccgagggtgtggtttcctgtttaaatgtagcctccccgctgcagaattgcagagcctgctgaattctggctgaccagggcagtcaccagagctccagacaatgtctgtctccttctcattctcctgccctatcggcctccagtgggtctcctgtacgactaaagtcagtctgccagcacggtccggaccaggtactggtagacgccctgccacgtaccctctaccactcacctgacccgataccggtcgaccggggatagttacttaccgttctaccgacgtttaactacggttaactttaggaacgttggtaacgtcgtaacgggtcctaaccgggtcccctaggtaactcgggacctttggacggtggtaccggtaaggggaacttacgtntttacccggaacgtacggttacagttacgttagttacttacgtagtatacgtgtaacgtgttacggtntaggttaganaggtacgagtacgactaattcgaccgttacaacgtaccgaaacgtagtacctcgtacggtcctacttcgacttacggttaccnctttaccgtacgttaccgtaaccgtcccgtaacccgtactaaccggg

SEQ ID NO: 147493 - DNA, 717 bp, Homo sapiens
  misc_feature: GYAE6OF01CYNKB.21.86.H09.1.454.CMB.1.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (646)..(646): a, c, t, g, unknown or other
  misc_feature (646)..(646): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccgagtcggggtntcctgtcgacaaatacagctgcctagcctaggtcccggtcaggacgtggtanaacgcccgtcgccgacgaccccttctccacctcctaccgtcgtacgacctacgtccgtccggggagtacgttactaccgtttactaccgtacctaacgttacggttaaccttgggtaaagtttcgggacttacgaggcctaaccggttccccccggtaggtaacggacggtacccgtttaggtacgtcggggtacgttaacggggaacgtaccgttacgtttaccgtaacgtacgggttcccaaggtacgttaggttactttccgtagtaatttagtcgtacgtacggttgtcttggtaggtagttaacgtagtaacgtggactagtacaccgtacgacctacccgaacggtaataacgtccgtacgtacgttaccccgngtaccgttaagtttcgacccttaccgttcgtttaccgtaccgtaccccgttacccggtaccgtaacccggg

SEQ ID NO: 147494 - DNA, 711 bp, Homo sapiens
  misc_feature: GYAE6OF01EG27S.21.86.H09.1.454.CMB.1.raw
  modified_base (216)..(216): a, c, t, g, unknown or other
  misc_feature (216)..(216): n is a, c, g, or t
  modified_base (361)..(361): a, c, t, g, unknown or other
  misc_feature (361)..(361): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcattcttcctgcccgtacgtcgggccctcccagttggggtntcctgtcgactaaatcagctgcagctacggtccggtcgaggtactggtacgaacgcccctcgcaccgtaccccttctaccacctccgacctcggaccgtaactacgtccgggtaccgggggaagtacgttactttacctttaacnccctaacctaagttacggttacgttagggtaattcggactcgacggtcctaccggttccccggtaggaggtaccggtccttggacggtggacggtaggggaaacgtctattcgaacgtacggtactaggtagttggttacttgtaggtattaggcgtacgtagttggttacgtggtaaggtaaggtaacgttacggtaagtccgggtaaactccgtaaccgtaaccgtaaacccgaacccgtaaccccgaaaggtaaacgtaccttaccggttaacgtttcccgtaccgttggtaccttacgttccgaccttaccgttcgtacgtacccgtaccctcccggaacgtaccg

SEQ ID NO: 147495 - DNA, 238 bp, Homo sapiens
  misc_feature: GYAE6OF01DJ7SX.21.86.H09.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
  modified_base (225)..(238): a, c, t, g, unknown or other
  misc_feature (225)..(238): n is a, c, g, or t
tcagtcgtcgctcgcacgaccggtgctcgatttagtgctatagacttgggtttggggccagggaaccctagtcaccgtctcctcagcctccaccaagggcccatcggtccttcccctggcgccctgcctccaggagccacctcgagagcacngcggccctgggctgcctggtacaaggaccttaccttcctcgtctctactgagcgggntggacaggcgcatagnnnnnnnnnnnnnn

SEQ ID NO: 147496 - DNA, 237 bp, Homo sapiens
  misc_feature: GYAE6OF01E1YB3.21.86.H09.1.454.CMB.1.raw
  modified_base (219)..(237): a, c, t, g, unknown or other
  misc_feature (219)..(237): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactactcccgagcgacgactgagcgggctggcaaggcacatagnnnnnnnnnnnnnnnnnnn

SEQ ID NO: 147497 - DNA, 787 bp, Homo sapiens
  misc_feature: GYAE6OF01DWF0S.21.86.H09.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttctcatcttcctgcccgtacgtcgggccctcccgagtcggggtctccgttgtaccgacaaataccaggctgaccagccgacggttcccggtaccgaggtacgtaggtacgaaccgtccccgtacggacctaccggtacccccttctaccaccgttcccaaccgttggaccgtaactacgtccgggtaccggggagtagttacttcctttacnccacctagtagttacgttaggtattggactcgacgccgtaccgtccccggtagacggacgtcgttaggaggtcggtacgtagggaacgtacttagttaccgtacgtacgggtaccaggtagttaggttactttcgtagtaagttacgtcgtacgttaggttaccgtgttcggtaaggaagtaaccgggttaaggaacgttaccggaaacgttacctaccggtaaacccgttaaacccgaacccggaacccccgtaaaacgggtaaacctaaccgttacccggtaaccgtttaccccgtttcccggtaaggttaaccgttttacgttaaccgggaccctttacccggtttacggttaacccggttcccgtaaacccccggtccccggtaaaccgggttaaccccg

SEQ ID NO: 147498 - DNA, 806 bp, Homo sapiens
  misc_feature: GYAE6OF01APA3S.21.86.H09.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctcagacaatgtctgtctccttcctcatcttccncgcccgtatcggcctccgagtggggtctcctgtcgaacaaatacagtctgacacgccgtacggtccggtaccgaggtacgtaggtcgaacgtcccctcgacctacgacccctcctactaccctcgacccgtcggaccgactacgtccgggtaccggggtaagtaaccgtttacttactttacctaccgtaaccgtacgtttaacgttacgtttaggttaacgttacgggtactacggaacggttccgtaccggttaccccggttaggaaccggttaccggtaccggtttaggacgggttacgggtaaccggttaggggaacggttaaccgtaactttaccggtaaccgttacggggttacccgaaggttacggtttacgtttaacgtttacggttaacggttaacttttacggacgttcggttaaggtttcgtacggtttaaggtaggtaaacgtaaggttaacgaaggttaacgtacgtaccttaaccaacggttaacccgaacccggaaaccgtaaccgtaaacgtaacgttaccgttacgtttacccgtcccgttagttatttacccgtgttaaccttacgtacggttaccgtaaccggacctcccggtaaccgtaccggg

SEQ ID NO: 147499 - DNA, 851 bp, Homo sapiens
  misc_feature: GYAE6OF01DKR1P.21.86.H09.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagtgctatagacttgggttgggggccagggtgtggtttcctgtttaaatgtagcctccccgctgcagaattgcagagcctgctgaattctggctgaccagggcagtcacagagctaccagacaatgtctgtcctccttcctnatcttcctagcccgtagtcgggcctccgaggtcggggtctccgtgtacgacctaaataccgacgcgttcgaccaagggtcctaacggttccccgggtaccgaggggtaccgttaggggtaaccggaaccggtccccgtacggacctaaaccggtaccccctacgtaccaaccttacccgaaccgttcggaaccgtaaccgtacggttcccggggaccggggaagtacggtttacttacctttaacaccctaaccgtaacgtttaaggttaaccggttacggtaaaagttcggaacgttaccggacggaccgttacccggtaccccggtggaaaccggtcggtacccgttaggtaccggtgggacggtaggggaactacctacgtttacgaccgtacgtagtagttacgttgggtttacttactaacggtaatttcggacgttcggtaaggtttcgtacggttaggtaaacggaacggttacgtaacgtaaggtaccggtaactaacgttaccgaaccgttaaccggaacccgacccgttaaaccggaaacttacgttaccccgttacctttacccggtaacccgttaggttaaccctttaaggtttccgaacccgttccgtttaaccgggtaccgggttccgttaaacccccgggccgttacgggttaaaccccgg

SEQ ID NO: 147500 - DNA, 951 bp, Homo sapiens
  misc_feature: GYAE6OF01CSFQQ.21.86.H09.1.454.CMB.1.raw
tcagtcgtcgctcgcacgaccggtgctcgatttagtgctatagacttggggtttggggggccagggtgtggtttcctgtttaaatgtagcctccccgctgcagattgcagagcctgctgaattctggctgaccagggcagtcaccgagacgcgtccagacaatggtctgtctccttcctcacttcttccgtcgcccgtacgtcgggccctacccgagttcggggtcgtccgttagtaccgactaaacgtaccgagtcctcggacaacggtcctaacgggtcccgggtaccgaacggggtaaccgttacggggtaacgtaaacccggccccttaccgggaccgtaaccggtacccccttaccgtaccctaaaccttcccgaaacccgttcggacccggtaaccgtaacgtccgggtaacccgggggagtaacggttacctttacgttttaacgtacctaaccgtaacttaacggttaacggttagggtaacgtttcgggtaacgttaccggtaacgggtaccccggttaaccgggtttacccccgggtaacgggtaacccggggtacccgggttacccgttaggggtaaccggggttcggggtaaccggggttttaaacggggggaaaccggtttaaaccgtacggtttacccgggtaaaccggtacggggttacccctaaagggttacgttttaccggggtttaacttaccggtttaaggtaacgtttaaccggtccgggtaaccgtttaggggttaccggtttaccggttagggttaacggaacgggttaaaccggttacggtaaacgtaacgggaccttaacgtaacccgtaacgtaacccggaaccgacccgaaacgtaacggtaccttacggtacttcccgccgttagtaccttagttacccgaccttactacccgttacggacctacccgtccggacgtaacccgg

SEQ ID NO: 147501 - DNA, 756 bp, Homo sapiens
  misc_feature: GYAE6OF01CDASR.21.86.H09.1.454.CMB.1.raw
  modified_base (174)..(174): a, c, t, g, unknown or other
  misc_feature (174)..(174): n is a, c, g, or t
tcagtcgtcgctcgcacgaccggtgctcgatttagtgctatagacttgggtttgggggccagggtgtggtttcctgtttaaatgtagccctcccccgctgcagaattgcagagcctgctgaattctggctgaccagggcagtcacagagctccagacaatgtctgtctccttcncatctcctgcccgtagtcggcctccgagtggggtctcctgtcgacaaatacagctgcacgcgacgtccggtccgagggactgggtcgaacgccctcgccacgaccctctcacctccacgtgaccacgtacgtccggtaccggggagtagttacttcttacgtactacctaagtacgttacgttaggtaagttaggactaccggacggtacgaccggttacccccgtaggacggtaccggtcttgggagggtcggtaacgggtacggggaaaggtactacgtttacgtacggtacggtaccgaaggttagtagggtttaccttacggtaggttaaatttacggtagtacgttacgggtttctcgggttaggtaggtaaaggttaacggttaacgggtaagttacgggtactaaccgttaaccgtaacccgtacgaaaccccggtaacccgaaccggtaaaagtaccgttacccgtaaccggttttcctaaccccgtaggtttacccttcggtttactaccccttaactttccggaccggtttaaccggaacccccgttacccggtaacccggtaaaccccggg

SEQ ID NO: 147502 - DNA, 800 bp, Homo sapiens
  misc_feature: GYAE6OF01EFEHA.21.86.H09.1.454.CMB.1.raw
  modified_base (770)..(770): a, c, t, g, unknown or other
  misc_feature (770)..(770): n is a, c, g, or t
  modified_base (787)..(787): a, c, t, g, unknown or other
  misc_feature (787)..(787): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgtaattcgtggctcgaccgaggggcagtccaaccgagacgcctccaagacaatcgtctgtcctccttcctctacttccttcccgtcgtcccgttacgtcgggtccccttacccgtaggttcgggggttcgttcccgttcggttaccgaacctaaaaacttaccgacgtccgttaggaccgacgtaccgtaaccggttccccgggtaccgaacggggtaccggttgggtacggaacccgtccccgtccgaccgaacccgtacccccttcctacctacccttccgtaacccgtcggaccgtaacctacgttcccgggtacccgggggaagttacggttaccttttactttacctaccctaaccttaacgttaggtttaacgttaggttaacgttcggtactacggtaacggccgttaaccgggtccccggtagtacggtaccggttcgttaggacggttcgggacggttacggggaacgtacttacgttaccgtacgtacggtaccgagttagttaggtttactttcgtaagttattcgtcgtgtacggttcgtgttacgtagtaacggtacgtacggaacgtcgaactactacctaaccgtacgaaccgaacccgaacgtaacgacttccgttactccgttccgtagcttatcnctacgttcagttacccncgtaccgcgtacg

SEQ ID NO: 147503 - DNA, 665 bp, Homo sapiens
  misc_feature: GYAE6OF01BVEYK.21.86.H09.1.454.CMB.1.raw
  modified_base (175)..(175): a, c, t, g, unknown or other
  misc_feature (175)..(175): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttccncatccttcctgcccgtactgggcctcccagtggggtgtcctgtcgacaaatccagctgcagcaggttccggtccaggtactgggtagaacggccccttacggccacggacccccttctcaacctcaccgtgccacactccggtaccgggganagttacttcttacncctacctactacgtacttaggaattcggaactcgacggctacggtcccccgtaggacgtacgggtccttggacggttcgggacgttaggggaaggtactatttccgtaacgacgggttaccaggtacgttgttacttcgtagtaattagtagcgtaggttcgtacgttgacggtagaacggttacggaacgtacgggacctacgtacgtacctaaccggaaccgaacccaaacggtaagtaaaccgttaccgtaccttacccgtcccttagtcctagttccacttaccgtccgttcggtaaccgccctaacggcccgtaaccgg

SEQ ID NO: 147504 - DNA, 241 bp, Homo sapiens
  misc_feature: GYAE6OF01EM8HE.21.86.H09.1.454.CMB.1.raw
  modified_base (170)..(170): a, c, t, g, unknown or other
  misc_feature (170)..(170): n is a, c, g, or t
  modified_base (223)..(241): a, c, t, g, unknown or other
  misc_feature (223)..(241): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctggctgcctggtnaaggacttacttccctcgtctctactggacggcgggctggcaaggcgcatagnnnnnnnnnnnnnnnnnnn

SEQ ID NO: 147505 - DNA, 236 bp, Homo sapiens
  misc_feature: GYAE6OF01D8G9G.21.86.H09.1.454.CMB.1.raw
  modified_base (218)..(236): a, c, t, g, unknown or other
  misc_feature (218)..(236): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactactccctcgtctctactgagcggctggcaaggcgcatagnnnnnnnnnnnnnnnnnnn

SEQ ID NO: 147506 - DNA, 763 bp, Homo sapiens
  misc_feature: GYAE6OF01AX1S8.21.86.H09.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagtgctatagacttgggtttgggggccagggtgtggtttcctgtttaaatgtagccctcccccgctgcagaattgcagagcctgctgaattctggctgaccagggcagtcacagagctccagacaatgtctgtctccttcctcatcttcctgcccgtacgtgggccctcccagtggggtgtcctgtcgacaaatacagctgcagccgtaggtccccggtacaaggtacgtgggtacgaacgcccctcgccaaccggacccctctcgacctcacctggacgacctacgtccggtaccggggataagtttacttccttttactaccaacccgtacgtttaagttacgtttaggtaaagtttcggactacgaacggccgtaacccggttcccccggtaggaacgggtccggtaccgtttaggaacggttcgggccgtaagggggaaacgtacgtacgtttccgtaaagaccgggtacctaagggtagttagggtttactttaccgttgtaagtttacncggtacgtaggttcgtttcgtaggtaggtaagtaaacgggtaaccgtaaggttacgggaaactacgtaaccgtaacccttaacggaacccaaaccccgtaaccggaaaagttaacctccggtaacctttcccgtacccgttaggtcctaagttttaccggaaccttaccgtcgttacggtacccgaaccccgttaccccgggacgtaaaccccgg

SEQ ID NO: 147507 - DNA, 756 bp, Homo sapiens
  misc_feature: GYAE6OF01BQG81.21.86.H09.1.454.CMB.1.raw
  modified_base (97)..(97): a, c, t, g, unknown or other
  misc_feature (97)..(97): n is a, c, g, or t
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (372)..(372): a, c, t, g, unknown or other
  misc_feature (372)..(372): n is a, c, g, or t
tcagtcgtcgctcgcacgaccggtgctcgatttagtgctatagacttgggtttgggggccagggtgtggtttcctgtttaaatgtagcctcccccgntgcagaattgcagagcctgctgaattcgtggctgaccagggcagtcacagagctccagactaatgtctagtcctccttcctacacttcttccncgcccgttagtcgggcctcccgtaggttcggggtntccgtgtacgacaaattcgagtctagcacgtcgtacggtcccggtacgaggtaccgtgggtacaacgtcccctcggaccaaccgtacccctgtaccactaccacgtcgaccgactcgccggtacgggatagttactttacgttaacnccgaacttacgttaagtacgttagtaaagttcggtaactacgacggccgtaaccggttccccgggaagtacggtaccgtcgtttaggacgggttcggaacggtacggggaactaccttacgtttaccgacgtacgggtactaaggttcgtttacgggttactttagtaacgtacgtttcacggtaacggtttacggtacgttcgtaagggtaacgaagggttaaacgtcggtaaagtacggtactaaaccgtaccgttaaacctaaccgggaacccttaaaccgagtaaacgtcctaaccggtcttttacccgcggttatacggttacgttacaccgtcgttaccgttacgggtaacccaacccggtacccggtaggtaccccg

SEQ ID NO: 147508 - DNA, 780 bp, Homo sapiens
  misc_feature: GYAE6OF01CWY7K.21.86.H09.1.454.CMB.1.raw
  modified_base (183)..(183): a, c, t, g, unknown or other
  misc_feature (183)..(183): n is a, c, g, or t
  modified_base (296)..(296): a, c, t, g, unknown or other
  misc_feature (296)..(296): n is a, c, g, or t
tcagtcgtcgctcgcacgaccggtgctcgatttagtgctatagacttgggttgggggccagggtgtggtttcctgtttaaatgtagcctcccccgctgcagaattgcagagcctgctgaattctggctgaccagggcagtccaccagagctccagacatgtctgtctcctcctctatcttccngcccgtacgtcgggccctaccagtcggggtctcctgtcgactaaatcagctgacacgcgtacggtcccggtacacgggtactggtacgaaccgccctcgaccacgtaccctcnccactccacctgaccactacgtccgtacggggactagttacttcctttacgacctaacccgtaacgtttacggttaacgttgggtaaaacttcgggtaacttaccggacggtacccgtaaccgggttcccccggtaggtaacggtccggttacctaggggtaacggtcggtaccggttaacgggggaactaccgtacgttaccgaaccggtaccggtacccgaagggttcttaggggttaaccttttacggtaagttaacgtttacggttaccgtaccggttaggttccgttaccgttagggtacggtaacggtaaacgttccggtaaagtccgggtaactaaccttccgaaaccggtaccgaacccgtaacccgacggtaaagtaccctccgtaacggttccctaccgttaggtacttacgtttaccgacgtttacccgttcgtacggttaccccgtacccgtcccggtaaaccgtacccggg

SEQ ID NO: 147509 - DNA, 717 bp, Homo sapiens
  misc_feature: GYAE6OF01EH1WP.21.86.H09.1.454.CMB.1.raw
  modified_base (66)..(66): a, c, t, g, unknown or other
  misc_feature (66)..(66): n is a, c, g, or t
  modified_base (124)..(124): a, c, t, g, unknown or other
  misc_feature (124)..(124): n is a, c, g, or t
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (564)..(564): a, c, t, g, unknown or other
  misc_feature (564)..(564): n is a, c, g, or t
tcagtcgtcgctcgcacgaccggtgctcgattttagtgctatagacttgggtttggggccagggtntgtttcctgtttaaatgtagcctccccgtgacagaattgcagcgcctgctcgattcgnggcctgaccagggctagtcgaccagtagcctacagacaatgtctgtctccttccngacttcttaccgtccctatcggacctccngttcgggtntacgtgctacaaagtcagcttggctacggcacgtccgtcgaagggccttaggcgtaaccgtccctgtccacggttaccctcacgaaccttcgaccgttacgacgtacacgtccggtacgggtattaacgtcgttacctttagccctagaacttacgttaacggtagtaagttggaacttccgaaacggtcgtaaccggtcccttagggaatccggtcgttaggcggtacggccgttaagggaactcgtttaacgtacgtaacggtacctacgtaacggttcgttaagggttaccctttagggtactacgttaacggtcgtaaccgttagtttcggtccttaagggtntaaccgtaggtaccgtaacgtcggtaacaccgtcgaacgttaccaaaccgccgtaaacagttaaccgtcctacgttcccgtaacggttcgtagtaacccgtttacggccttaacgttccggttcctaaggttccccctaacggcccctaaggg

SEQ ID NO: 147510 - DNA, 719 bp, Homo sapiens
  misc_feature: GYAE6OF01A1TTI.21.86.H09.1.454.CMB.1.raw
  modified_base (607)..(607): a, c, t, g, unknown or other
  misc_feature (607)..(607): n is a, c, g, or t
tcagtcgtcgctcgcacgaccggtgctcgatttagtgctatagacttgggtttgggggccagggtgtggtttcctgtttaaatgtagccctcccccgctgcagaattgcagagcctgctgaattctggctgaccagggcagtcaccagagcctcagacatgtctgtctccttcctcattccttccgtcgcccgtacgtcgggccctcccgagttcggggtcgtcctggtcgactaaacgtcagtctcggacagccgtacggtcccggtaccgaggacgttggtacgaaccgtccccgtacgaccgtaaccgtaccccttctaccgtaaccctccgtaacccgttcggaaccctaaccgtcgtaccggggttacccggggaagtacgttactttaccgtttacctaccgtaaccctaacgtttacgttaacgttaggtaacgtttaggactacggacggccgtaaccggtcccggtacgaggtacggttccgtaggtagtcggggacggtacggaacgtacctagtaccgtacgtacggttaccaggttagtcgtttatagtataacttgacgtgtacgtgtacgtgtagagtagtcgagtcgaactntaccaactaccgaacccgaccgaactacgtacttccgtaccgtccgtaccttagtcccttaacttcgaacgttcccgtggttaacaccccggtcctaacccggatacccggg

SEQ ID NO: 147511 - DNA, 698 bp, Homo sapiens
  misc_feature: GYAE6OF01CLGV8.21.86.H09.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccaggcagtcaccagagctccagacatgtctgtctccttcctcactcttcctgcccgtatcgggcctccagtggggtntcctgtcacaaatcagctgcagcagtccgtaccaggactgggtcaacgcccgtcgcaacgacccttcgactaccttccgacccgttgaccgtaactcgtaccggtaccggggtatacggttaactttctttaccacctaacctagtaacgtaacgtttcggaaatttcgggaatcccgtaggcctacgggttcccccgtagacggtacgttcccgtggtacgttagggccggtttaaggggaaaccggtcttaacgttacccgtaacggtacggttacccgaaggttactacgggttacttacgtagtaattacgtacgacgtgttacgttcgtaggtacggtaagtaacggtagtaacgtacggtaactacgtacgacttaaccggaacgaccccgtaagtaacgtaacgttccgtaacgttccgttccgacttactaacgtttccgacctacctacgtacgtccgtaaccccttcggacgtaacccgg

SEQ ID NO: 147512 - DNA, 747 bp, Homo sapiens
  misc_feature: GYAE6OF01EK360.21.86.H09.1.454.CMB.1.raw
tcagtcgtcgctcgcacgaccggtgctcgatttagtgctatagacttgggtttggggccagggtgtggtttcctgtttaaatgtagcctccccgctgcagaattgcagagcctgctgaacttctggctgaccaggcagtcaccgagagctccagacaatgtctgtctccttcctcattcttcctcgcccgtactcgggccctccgagtcggggtctcctgtcgacaaatcagctgcgagcacgtccgtcaggtacgtggtcgacgcccgtcgaccacgacccttctacgacctccaccgtcgacctactacgttccggtaccggggtaagtacgttactttaccgttttaactacccgtaaccgttaacgttaacgttacggtttacggtaaacgtttcggtaacgttccgaggtccgtaccggtccccggtaggtacggtacggtccgttaggaccggttcgggacggtacgggaaccgtacttacgttaccgtaacggtacggtaccaggtacgtttacgggttaacttcgtaagttacgtttacgtcgtaccgttaggttcgttacgtagggtaacgaaggttacgttaaccgtaagtacggtacaacgttacgaaccgttaaccgaccgaaccccgtaagtaagtacccgttcgtaaaccgtttccgtcccgtaggtactttaccgttacgtaccctaactttccggtacgtaccccgtaccggtaccccgacggttaacccg

SEQ ID NO: 147513 - DNA, 793 bp, Homo sapiens
  misc_feature: GYAE6OF01A78MB.21.86.H09.1.454.CMB.1.raw
  modified_base (97)..(97): a, c, t, g, unknown or other
  misc_feature (97)..(97): n is a, c, g, or t
  modified_base (148)..(148): a, c, t, g, unknown or other
  misc_feature (148)..(148): n is a, c, g, or t
  modified_base (183)..(183): a, c, t, g, unknown or other
  misc_feature (183)..(183): n is a, c, g, or t
tcagtcgtcgctcgcacgaccggtgctcgatttagtgctatagacttgggtttgggggccagggtgtggtttcctgtttaaatgtagcctcccccgntgcagaattgcagagcctgctgaattctggctgaccagggcagtcaccagngctccagacaatgtctgtctccttctcatcttccngcccgtactggcctccgagtgggtcgtcctgtcgacaaagtccagtcctgcacgcacgtcccggcaggactggtcgaaccgccctcgaccacgtacccctctaccacctaccaccgttcgccgtacctacgtacccggtcccgggggaagtacgttacttcctttaactaccaacctaacgtttacgttaaccgttaggtaacttaggacttacgacggtccgtacggtccccgtacggagtaccggtccgtttaggacggtacggtcggtaaggggaaacgtacttacgttacgtaccggtacggtacccgtaggtaacgtttacggttaacgtttacgtcggttaaacgtttgtacggtacgttaacgttcgtttacggtacgggttaggttaacggttaaacggttacggtaaacgggttaccgttaacgtaccgttaacccgttaaccgttaaacccgaacccggtaaccccgaaacggttaaacgttaaccggttaccgttaaccgtttaccccgttacccgtacgttaccgttaggttacccgtacgtaccgtttacggtaccggttaacccgtaccccgttaccccggaacgggttaaccccg

SEQ ID NO: 147514 - DNA, 721 bp, Homo sapiens
  misc_feature: GYAE6OF01A5P5W.21.86.H09.1.454.CMB.1.raw
  modified_base (175)..(175): a, c, t, g, unknown or other
  misc_feature (175)..(175): n is a, c, g, or t
  modified_base (260)..(260): a, c, t, g, unknown or other
  misc_feature (260)..(260): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgattctggctgaccagggcagtcacagagctccagacatgtctgtcctaccttccacnttcttctcgcccgtacgtcggccctccagttggggtctcctagtcgacaaatcgagctgcacgcgacgtccggtcaagcgttggngaaccgccctgacctacgaccctcgtacctactccaccgtgaccgtcgtacgtcgggtaccggggatagtttaccttcctttacacctaaccgtacgttacgttaccggttaggtaattcggaactcggacgtcgtaccggtcccgaggtaacgccgtcttaggcggtacggtacggtaggtaaacgtcttagttccgacggtaccggtataggtacgttacggtttaacttcgtagttaaactttcggattccggttaaggtcccgttaggtagtagaacgggtactaacggtacgtacggtaactaccgtaccgtaacgtaccgaccgaaaccgtaccgttaaaggacccttccggttaaccttccggttccgttagttaaccgtttaacgtccggttaactaccggttaccgtttacggaaccccggtttaccccggttaacccgacggttaacccgg

SEQ ID NO: 147515 - DNA, 930 bp, Homo sapiens
  misc_feature: GYAE6OF01DIJ2U.21.86.H09.1.454.CMB.1.raw
  modified_base (97)..(97): a, c, t, g, unknown or other
  misc_feature (97)..(97): n is a, c, g, or t
tcagtcgtcgctcgcacgaccggtgctcgatttagtgctatagacttgggtttgggggccagggtgtggtttcctgtttaaatgtagcctcccccgntgcagaattgcagagcctgctgaattcgtggctgaccagggcagtccaccagacgctccaagactaagtcgtctgttcctccttcctctacgttccttcctcggtcccgttacgtcgggacccttccgaggttcggggtctccttagtcgaacaaaatcacgtctggcagccgtacgggtcccggtacgagggtaccgttagggtacgtaaccgcccccgttccggaccgtaacccggtaaccccttccgttacccaaccgttccccgtaccgtcgggaccccgtaaccgtaccggtttaccccggggtaaccggggggaaattaacccggttttaacgtttaccctttttaaaaccgtaaccccctaaaacccggttttaaccgtttaaacgggttttaaaccggttaagggttaaaaacggttcgggtttaaaacccgtcgggtaacccggtaccccggttaacccgggtttaccccgggaacggttaagggtaccggttacccggtggggttaacggtcggggtaccgggtaaaggggttaaactaccggtttacgttaaccgtaacgtaccggtaacggtaagttacgtttagggtttaactttcggttaacgttagttaacggtgtacggtttcggttcgtagttaagggttacggaaacgttagggtacgtaaagtcggttaaactcgtaaccctactaaacgaacccggtaccaaaccgggtaaattaccctacggtacccttacccgtacgttagttacccttgggttacccaccgtttctttcggtaaccgtacccggtaccccgttcgaacccggggttaccc

SEQ ID NO: 147516 - DNA, 773 bp, Homo sapiens
  misc_feature: GYAE6OF01C7HXB.21.86.H09.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagtgctatagacttgggtttgggggccagggtgtggtttcctgtttaaatgtagcctccccgctgcaagaattgcagagcctgctgaattctggctgaccagggcagtcaccagacgctccagacaattgtctcgtcttccttcctnacttcctttccgtcgtcccgttacgtcgggcccttaccgaggttggggtctccgttcgtaccgaactaaaacttcgagtccgtgaccgacggtccgtacggttcccggaccgaaggtccgttagggtaacgtaacccgccccttcgaccgtaaacccggtaccccttccgtacctaccctaccgaaccgttcggacccgtaactaccggtccggtacgggggaattacgtttactttacctttacaccgtaaccctaagttacgtaccgttagtaacgtggactcgaggtcctaccggtcccgaggtacgtacgtccgttagacggtggtaccggtagggaaatctacgttaccgacgtacgtaccgtaaggttagttacggttactttcgtagttacttacgcgtacgttaggttccgtagtaggttaggaacggttaagtcggtaaagtacgtaaccgtactacgtaaaccacgtaacccgaccctaaggtaaacttacctaccggttaacgttcccgtacctggtttacttaccttaccgaccttaccgtttcggaacgttacccgtaacccgtcggtacccgttaccgg

SEQ ID NO: 147517 - DNA, 772 bp, Homo sapiens
  misc_feature: GYAE6OF01B0VLI.21.86.H09.1.454.CMB.1.raw
  modified_base (425)..(425): a, c, t, g, unknown or other
  misc_feature (425)..(425): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccagtggggtctcctgtcgacaaatacagctgcagcacgtccggtaccgaggtactggtcgaacgcccctacgccacgtaccctctccacctccacctgccgactacgtccgtaccggggatacgttattactttactacctaacctaacgtacgttacgttaggtaacgttggtactccgaacggacctacggtccccggtacgacggtacggtcccttaggnggtacgggcgtaggggaacggtactacgtttaccgtaccgtacggtaccgaggtagttacgggttactttacgttagttaacgtttacgtacgcgttaaggttcgttacgtggttacggaacggtacgtacggtaacgtacgggtaacctagtaccgtaaaccgttaacccgaaacggtaacccccgtaaaccggtaaacgttaacgttacccgtaaacggtttttcccccgtaacccggttacgttaacccttaacggttttaaccgaccccggtttaacgtttacccggtacgggtttaaccccgaccccccggtttacccccgggaaacccggttaaccccggg

SEQ ID NO: 147518 - DNA, 226 bp, Homo sapiens
  misc_feature: GYAE6OF02JDGWA.21.86.H09.1.454.CMB.1.raw
  modified_base (219)..(226): a, c, t, g, unknown or other
  misc_feature (219)..(226): n is a, c, g, or t
tcagtcgtcgctcgcacgaccggtgctcgatttagtgctatagacttgggtttgggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnn

SEQ ID NO: 147519 - DNA, 223 bp, Homo sapiens
  misc_feature: GYAE6OF02G2V0A.21.86.H09.1.454.CMB.1.raw
  modified_base (219)..(223): a, c, t, g, unknown or other
  misc_feature (219)..(223): n is a, c, g, or t
tcagtcgtcgctcgcacgaccggtgctcgatttagtgctatagacttgggtttgggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnn

SEQ ID NO: 147520 - DNA, 220 bp, Homo sapiens
  misc_feature: GYAE6OF02IH3ZC.21.86.H09.1.454.CMB.1.raw
  modified_base (219)..(220): a, c, t, g, unknown or other
  misc_feature (219)..(220): n is a, c, g, or t
tcagtcgtcgctcgcacgaccggtgctcgatttagtgctatagacttgggtttgggccagggaaccctagtcaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnn

SEQ ID NO: 147521 - DNA, 221 bp, Homo sapiens
  misc_feature: GYAE6OF02IB857.21.86.H09.1.454.CMB.1.raw
  modified_base (219)..(221): a, c, t, g, unknown or other
  misc_feature (219)..(221): n is a, c, g, or t
tcagtcgtcgctcgcacgaccggtgctcgatttagtgctatagacttgggtttgggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 147522 - DNA, 222 bp, Homo sapiens; identical to SEQ ID NO: 147443
  misc_feature: GYAE6OF02IY4Z2.21.86.H09.1.454.CMB.1.raw
  modified_base (220)..(222): a, c, t, g, unknown or other
  misc_feature (220)..(222): n is a, c, g, or t

SEQ ID NO: 147523 - DNA, 222 bp, Homo sapiens; identical to SEQ ID NO: 147443
  misc_feature: GYAE6OF02GYE3Y.21.86.H09.1.454.CMB.1.raw
  modified_base (220)..(222): a, c, t, g, unknown or other
  misc_feature (220)..(222): n is a, c, g, or t

SEQ ID NO: 147524 - DNA, 222 bp, Homo sapiens; identical to SEQ ID NO: 147443
  misc_feature: GYAE6OF02H7KAX.21.86.H09.1.454.CMB.1.raw
  modified_base (220)..(222): a, c, t, g, unknown or other
  misc_feature (220)..(222): n is a, c, g, or t

SEQ ID NO: 147525 - DNA, 226 bp, Homo sapiens
  misc_feature: GYAE6OF02JOAHA.21.86.H09.1.454.CMB.1.raw
  modified_base (220)..(226): a, c, t, g, unknown or other
  misc_feature (220)..(226): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnn

SEQ ID NO: 147526 - DNA, 224 bp, Homo sapiens; identical to SEQ ID NO: 147454
  misc_feature: GYAE6OF02HYY4S.21.86.H09.1.454.CMB.1.raw
  modified_base (220)..(224): a, c, t, g, unknown or other
  misc_feature (220)..(224): n is a, c, g, or t

SEQ ID NO: 147527 - DNA, 221 bp, Homo sapiens; identical to SEQ ID NO: 147446
  misc_feature: GYAE6OF02GOJVZ.21.86.H09.1.454.CMB.1.raw
  modified_base (220)..(221): a, c, t, g, unknown or other
  misc_feature (220)..(221): n is a, c, g, or t

SEQ ID NO: 147528 - DNA, 222 bp, Homo sapiens
  misc_feature: GYAE6OF02GME6T.21.86.H09.1.454.CMB.1.raw
  modified_base (220)..(222): a, c, t, g, unknown or other
  misc_feature (220)..(222): n is a, c, g, or t
tcagtcgtcgctcgcacgaccggtgctcgatttagtgctatagacttgggtttgggaccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 147529 - DNA, 227 bp, Homo sapiens
  misc_feature: GYAE6OF02FE7P0.21.86.H09.1.454.CMB.1.raw
  modified_base (213)..(213): a, c, t, g, unknown or other
  misc_feature (213)..(213): n is a, c, g, or t
  modified_base (219)..(227): a, c, t, g, unknown or other
  misc_feature (219)..(227): n is a, c, g, or t
tcagtcgtcgctcgcacgaccggtgctcgatttagtgctatagacttgggtttggggccgagggaaccctagtcaccgtctcctcagcctccaccaagggcccatcggtcttcccctggcgccctgctccaggagcacctccgagagcacagcggccctgggctgcctggtcaggactacttccctcgtctctctgagcgggctggcaaggcncatagnnnnnnnnn

SEQ ID NO: 147530 - DNA, 221 bp, Homo sapiens; identical to SEQ ID NO: 147446
  misc_feature: GYAE6OF02G3MVP.21.86.H09.1.454.CMB.1.raw
  modified_base (220)..(221): a, c, t, g, unknown or other
  misc_feature (220)..(221): n is a, c, g, or t

SEQ ID NO: 147531 - DNA, 565 bp, Homo sapiens
  misc_feature: GYAE6OF02HDSHE.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtccggtccaggactggtgaacgccctcgcacgacccctctcactccacctgcgacactccgtccggggagagtatctttatcaccactagtacttggattgatcagcacgtcccgtcgagacggtctggacgtggcgtggggaagactattcgaacgacggtaccagtagtggttacttcgtagtatttagtgctagttgtctgtgagtagtcgaatggacagtcaacgtacacgaacccacgaagactacgtacgttcctcccgtagtacgttactttcggactacgttccgttacggtaccggtacccgtacccggacgtaacccgg

SEQ ID NO: 147532 - DNA, 224 bp, Homo sapiens; identical to SEQ ID NO: 147454
  misc_feature: GYAE6OF02FT932.21.86.H09.1.454.CMB.1.raw
  modified_base (220)..(224): a, c, t, g, unknown or other
  misc_feature (220)..(224): n is a, c, g, or t

SEQ ID NO: 147533 - DNA, 227 bp, Homo sapiens
  misc_feature: GYAE6OF02HMJQS.21.86.H09.1.454.CMB.1.raw
  modified_base (216)..(227): a, c, t, g, unknown or other
  misc_feature (216)..(227): n is a, c, g, or t
tcagtcgtcgctcgcacgaccggtgctcgatttagtgctatagacttggtttggggtccagggaaccctagtcaccgtctcctcagcctccaccaaggcccatcggtcttcccctggcgccctgctccaggagcactccgagagcacagcggccctgggctgcctggtcaaggactacttcctcgtctctactgagcggctggcaaggcgcatagnnnnnnnnnnnn

SEQ ID NO: 147534 - DNA, 723 bp, Homo sapiens
  misc_feature: GYAE6OF02IDVOL.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgattctggctgaccagggcagtcaccagagctccagacaatgtctgtctccttcctcatcttcctgcccgtactgggcctcccatggggtgtcctgtcgcaaatacagctgcagcagtccggtccaggactggtgaagccctcgcagacccctctcactcacctgccgacatcctccggggggagtagtactttactttacaccaacctacgttaacgttacgttaaggttagttaggtactacggacggaccgtacccgttccccggacggacggaccggttacgttaggtacgggtcgtcgggtaacggggaacggtaacgtttaccgttaccgtaacggtaccggtaaccgtaagttacgggttacgtttactttcggtagttaagttagtacgtacggtacggtttacgtcgttaggtagggtaaacgtaaggtaacgtaaggtaacgacctacgtacctaaccgaacgtaacccaaaccccggaaacgtaaacgtaacctacggtttaccgttcccctaccggtactaaccgtttaccgttacgtacccttaccttcggtacggtttacccgtaccccgtacccggaccgtaaccccggg

SEQ ID NO: 147535 - DNA, 510 bp, Homo sapiens
  misc_feature: GYAE6OF02IZXEC.21.86.H09.1.454.CMB.1.raw
  modified_base (210)..(210): a, c, t, g, unknown or other
  misc_feature (210)..(210): n is a, c, g, or t
  modified_base (312)..(312): a, c, t, g, unknown or other
  misc_feature (312)..(312): n is a, c, g, or t
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtntcctgtcgcaaatacagctgcagcagtccggtccaggactggtgaagccctcgcagacccctctcactcacctgcgacatcgtccggggagagtatctttancaccactagtacttggaattgatcaggcagtccccgtgagacggccttgagtggcgtgggaagactattctacaggtccagatggtattcgtgattangtcagtgtctgtgtagaagtgaatgganatcactacagacccacgaanactcagttcctcctgctagttcgctactcgtcgtcgaccttccgacgtaccg

SEQ ID NO: 147536 - DNA, 228 bp, Homo sapiens
  misc_feature: GYAE6OF02F16PB.21.86.H09.1.454.CMB.1.raw
  modified_base (220)..(228): a, c, t, g, unknown or other
  misc_feature (220)..(228): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnnn

SEQ ID NO: 147537 - DNA, 243 bp, Homo sapiens
  misc_feature: GYAE6OF02HCTN6.21.86.H09.1.454.CMB.1.raw
  modified_base (222)..(243): a, c, t, g, unknown or other
  misc_feature (222)..(243): n is a, c, g, or t
tcagtcgtcgctcgcacgaccggtgctcgatttagtgctatagactttggggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnnnnnnnnnnnnnnnn

SEQ ID NO: 147538 - DNA, 533 bp, Homo sapiens
  misc_feature: GYAE6OF02JD466.21.86.H09.1.454.CMB.1.raw
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (467)..(467): a, c, t, g, unknown or other
  misc_feature (467)..(467): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtntcctgtcgcaaatacagctgcagcagtccggtccaggactggtgaagccctcgcagacccctctcactcacctgcgacatcgtccgggganagtatctttancaccactagtacttggaattggatcaggcacggtccccgtgagaggccttgagtggcgtagggaagactattctacgaggtccagattggtattcgtgtattagtgactaggtgtcgtgtgtagagtacgatgacatcactacacacccacgaanaactctagttcctcctagtctacgtttacgactacgttctacgtcgtaccctaccccgacgtaccg

SEQ ID NO: 147539 - DNA, 600 bp, Homo sapiens
  misc_feature: GYAE6OF02I7HBQ.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatcagctgcagcagtccggtccaggactggtgaagccctcgcagaccctctcactcacctgcgacatccgtccggggagagtattctttatcacctactagtacttggaattggatcaggcacgtcccgtgagaggccttgagtggcgtgggaagactattctacaggtccagagtggtattcgtagtattatgtactaggttgttacgttggtagagtaacgtacgaagtggactagttacctaaccgtaccgaacgaaccccgaacggaaacgtactaccgtaacgtttaccctccccgttacggtaccttaagttttaccgaccgttaccgttcgttaacggttccgtaacccgttaccccggaacgtaaccccgg

SEQ ID NO: 147540 - DNA, 557 bp, Homo sapiens
  misc_feature: GYAE6OF02IAJ2M.21.86.H09.1.454.CMB.1.raw
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtccggtcaggactggtgaagccctcgcagaccctctcactcacctgcgacatcgtccgggganagtatctttatccaccactagtacttggaattggatcaggcagtcccgtgagnggcttgagtgctgggagactattctacgaggtccagtatggtattctagattagtgactaggttgtcgtgtagagtaaggttcgaaagttgggaactagttaccacgttaacacgaaacccaaccgaagtaactcgtaacgtttcctcctagtctagttttcgaccttcttcgtagtccgtaccgttaccccggacgtaacccgg

SEQ ID NO: 147541 - DNA, 588 bp, Homo sapiens
  misc_feature: GYAE6OF02GUDDR.21.86.H09.1.454.CMB.1.raw
  modified_base (528)..(528): a, c, t, g, unknown or other
  misc_feature (528)..(528): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtgtcctgtcgcaaatacagctgcagcagtccggtccaggactggtgaacgccctgcagacccctctcactcacctgcgacactccgtccggggagacgttactctttactccaacctacttagtaccttaggaattggatcgaggcacgtccccgtgagacggcttggagtggcgtaggggaacgactagtttccaacgacggtaccaaggtagtggttattctagtattagtcgactagttgtcgtggtagaagtaagtcgaagtcggaactatacaactaacgaccgaacccaaacgaagtactcgtacggtttccncccgttagaccttattcgactacgttcgttacggtacgtacccgtcccgacgtaacccgg

SEQ ID NO: 147542 - DNA, 547 bp, Homo sapiens
  misc_feature: GYAE6OF02IR318.21.86.H09.1.454.CMB.1.raw
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagtcgtcgctcgcacgaccggtgctcgatttagtgctatagacttgggtttgggggccagggtgtggtttcctgtttaaatgtagcctccccccgctgcagaattgcagagcctgctgaattctggctgaccaggggcagtcaccagagctccagacaatgtctgtctccttcctcatcttcctgcccgtactgggcctcccatggggtgtcctgtcgcaaatacagctgcagcagtcccggtccaggactggtgaacgccctcgcacgaccctctcactcaccgtgacgacagtccgtccggggagtagtattctttanccacctactacgtacttggaatggatcgagcacgtcccgngagcggccttgngtggcgtgggaagcattcacgnggtaccagatggtnttgagattntgctgtgtctgtgaagtagtacgaagtggactataccactacaaccgacccgaaacgaagtaactctacgttccctcccgtagtctacttcgactactcgttgtaccgaccgtaccccggatacccgg

SEQ ID NO: 147543 - DNA, 586 bp, Homo sapiens
  misc_feature: GYAE6OF02HIAK5.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtcccggtccaggactggtgaagcccctcgcacgaccctctcactcacctgcgacatccgtccggggagagtattctttatccaccactagtacttggtaattggatcaggccacgtccccgtgagcggtcttggagtgggactggggaacgactattaccagacggtccaaggtattgggttattcgtagtatttagtagcgtagttcgttcgtggtagaagtaacgtcgaagtggaactatacctaacaccacggaacccaacgaaacgtaacttctaacgttccctcccgtagtacctagtttacgcctacgttcgttccgtacgtacccgtcccggaaccgtaccgg

SEQ ID NO: 147544 - DNA, 255 bp, Homo sapiens
  misc_feature: GYAE6OF02G9XWU.21.86.H09.1.454.CMB.1.raw
  modified_base (223)..(255): a, c, t, g, unknown or other
  misc_feature (223)..(255): n is a, c, g, or t
tcagtcgtcgctcgcacgaccggtgctcgatttagtgctatagacttgggtttggggtccagggaaccctagtcaccgttctcctcagcctccaccaagggcccatcggtcttcccctggcgccctgctccaggagcgacctccgagagcacaggcggccctgggctgcctggtcaaggcctacttcctcgtctctactgagtcggctggcaaggcgcatagnnnnnnnnnnnnnnnnnnnnnnnnnnnnnnnnn

SEQ ID NO: 147545 - DNA, 634 bp, Homo sapiens
  misc_feature: GYAE6OF02JJS8F.21.86.H09.1.454.CMB.1.raw
  modified_base (210)..(210): a, c, t, g, unknown or other
  misc_feature (210)..(210): n is a, c, g, or t
  modified_base (319)..(319): a, c, t, g, unknown or other
  misc_feature (319)..(319): n is a, c, g, or t
  modified_base (511)..(511): a, c, t, g, unknown or other
  misc_feature (511)..(511): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtntcctgtcgcaaatacagctgcagcacgtccggtccaggactggtgaacgccctcgcagcccctctcactcacctgcgacagtccgtccggggagagttactctttaacncctaaccactagttacttggtaaattggatcgaggccacggtccccgtgacgtacggccgttgacggtggtacgtagggaaacggtactacgttaccgtacgacggtaccaggtacgttaggttatttacgtaggtattaagtcgtacgtggttagttcgtggtagtaggtaaaggtacgaagtaggaactntactaaccgtaacgaccgtaaacccgaagtaacgacgttaccgtaacggtttcccgtcccgttatacgttactttcgtaccttacgttcgtacgtacccgtaccgtacccggacgtaacccgg

SEQ ID NO: 147546 - DNA, 536 bp, Homo sapiens
  misc_feature: GYAE6OF02HCN0R.21.86.H09.1.454.CMB.1.raw
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtccggtccaggactggtgaacgcccctgcacggacccctctcactcacctgcgacactcgtccgggganagtatctttancaccactagtacttggaattggatcaggcacgtcccgtgaggaggcttgagtggcgtgggaagacattcacgaggtccaggatggtattcgtagattagtgcaggttgtctggtgaagagtacgagtggacatcaactacacgacccaacgaagaactcgacgttcctcctgtactagtttcgctacgttctggtcgaaccgttacccggacgtacccgg

SEQ ID NO: 147547 - DNA, 519 bp, Homo sapiens
  misc_feature: GYAE6OF02HNXKD.21.86.H09.1.454.CMB.1.raw
  modified_base (299)..(299): a, c, t, g, unknown or other
  misc_feature (299)..(299): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgcccgtactgggcctcccatggggtgtcctgtcgcaaatcagctgcagcagtccggtccaggactggtgaacgccctcgcagaccctctcactcacctgccgacatctccgggganagtatctttatcacctactagtacttggaattggatcaggcagtccccgtgagaggccttgagtggctgggaagacattctacgaggtaccagactgggtattcgtagtattatgctagtgtctgngagaagtcaaatggacntcactacacgaccacgaanaactcagttctcctagcctatttcnctactcgtagtcgtaaccctcccgaagtacccg

SEQ ID NO: 147548 - DNA, 669 bp, Homo sapiens
  misc_feature: GYAE6OF02GY25R.21.86.H09.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccatggggtgtcctgtcgcaaatcagctgcagcagtccggtccaggactggtgaagccctcgcagacccctctcactcacctgccgacatccgccggggagagtattcctttanccaacctacgttagttacttaggattggatcgaggcacgtcccgtagagcggtcttggagtggcgtaggggaacgactacttacacgtacggtaccaaggtattcggttaactttcgtagtatttagtcgtacgtaggttcgttcgttaggtagaagtaacggtacgtaaagtacgggtaacctacgttactaaccgttaaccgaaccggaaccccgtaaaccgtaaacgtaaccgttacccgttacgtttacccgttccccgttaacgttccgttaacgtttttacggacccttaaccgtttccggttaccggttacccggtacccgttacccccgggaaccgtaaccccggg

SEQ ID NO: 147549 - DNA, 806 bp, Homo sapiens
  misc_feature: GYAE6OF02J2QA5.21.86.H09.1.454.CMB.1.raw
tcagtcgtcgctcgcacgaccggtgctcgatttagtgctatagacttgggtttgggggccagggtggtggtttcctgtttaaatgtagcctccccgctgcagaattgcagagcctgctgaattctggctgaccagggcagtcaccagagcctccagacaatgtctgtctccttctcatctcctgcccgtactgggcctcccagtgggggtctcctgtcgacaaaatccagctgcagccaggtcccggtccaggtaccgtgggtacgaacgcccctcggccaacgacccccttcgcctacctccaacccgtggaccctaactacgttcccggtaccggggggaataacggtttaacttccttttaacaccgaaccctaacgttaaggttaccgtttagggtaaactttcggaattaccgacggggtacctaaccggggttcccccgaggtaaacggtacgggttccgttaggaacgggttcgggaacggttaacgggggaaacgtactaacgtttaccgaacgtaccgggaccgtaaggtaacgttagggttactttcgtaggttaacttagcgtacgttacgggttagttcggtagtagggtaacggtaaccggttaaggaacgttaaggtaaccgtaacgtcctaaacgttaacccaaaccggaaccccgtaaaagggtaacctaccggttacgttacccggttttaccgaccccgtttaggtaaccttaccggttttaacggacccttaccggttacctaccgggttaacccggtacccccggttaacccggacccgtaccggg

SEQ ID NO: 147550 - DNA, 654 bp, Homo sapiens
  misc_feature: GYAE6OF02HBT13.21.86.H09.1.454.CMB.1.raw
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
  modified_base (456)..(456): a, c, t, g, unknown or other
  misc_feature (456)..(456): n is a, c, g, or t
tcagtcgtcgctcgcacgaccggtgctcgatttagtgctatagacttgggtttgggggccgagggtgtggtttcctgtttaaatgtagcctccccgctgcagaattgcagagcctgctgaattctggctgaccagggcagtcaccagagctccagacaatgtctgtctccttcctcatcttcctgcccgtactgggccctcccgagtggggtgtcctgtccgacaaatacagctgcagcagtccggtccaggactggtgaacgccctcgcacgacctctcactccaccgtgcgacatcgtaccggggagngtactctttancaccatagtactggatggatcaggcagtcccggngagacggcctttagacgtgggctgggggaaacgtacgatttccgtaacgtacggtaccaggtactagggttaacttcgtaggtacttagtcgtgaaggttntcgttcgtagacggaagtcgtaaaacgtcggtaactactaaccgtaacgtaaccgaacgggtaaaccccaaacccggtaaagtaaccgtaccgttaacggttccccgttcccgttaagccgttaacgtttttacggacccttaccggtttccgtaccggttacgggtaacccgttacccccggtaacgtaaacccggg

SEQ ID NO: 147551 - DNA, 227 bp, Homo sapiens
  misc_feature: GYAE6OF02GINZP.21.86.H09.1.454.CMB.1.raw
  modified_base (220)..(227): a, c, t, g, unknown or other
  misc_feature (220)..(227): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnnn

SEQ ID NO: 147552 - DNA, 560 bp, Homo sapiens
  misc_feature: GYAE6OF02HJXJI.21.86.H09.1.454.CMB.1.raw
  modified_base (209)..(209): a, c, t, g, unknown or other
  misc_feature (209)..(209): n is a, c, g, or t
  modified_base (314)..(314): a, c, t, g, unknown or other
  misc_feature (314)..(314): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactggcctcccatggggtntcctgtcgcaaatacagctgcagcagtccggtccaggactggtgaagccctcgcagaccctctcactcacctgcgactatccgtccggggatacgtactctttanccaacctactagttaccttaggaattggatcgagtcacgtccccgtgagtcgccttgacgtgcgtagggaacgactattcacgtagtccagtagtggtattcgtagtattagtgctagtgtctgtagtagaagtcgaagtcgacacgtcaacgtaccgaacgaaccctaacgaacgtactacgtacgtttcctccgtgtactatttcgaccttctcgttacgtacgtaccctcccgacgtacccgg

SEQ ID NO: 147553 - DNA, 545 bp, Homo sapiens
  misc_feature: GYAE6OF02FN9B1.21.86.H09.1.454.CMB.1.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (414)..(414): a, c, t, g, unknown or other
  misc_feature (414)..(414): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatcagctgcagcagtccggtccaggactggtgaagccctcgcacgaccctntcactcacctgcgacatcgtcgggganagtatctttancaccatagtactggaattggatcaggcacgtccccgtgagaggccttgagtggctagggaacgactattcgacaggtccagacgtggttattcgtagatttagngtacagttgttctggtgaaggaagttcggaaatgggaaccattaccgaacttacaacgtaaacccacggaaagactcagtttcctcctagtactagtttcgactacttcgtggtcgacctacccgacgacg

SEQ ID NO: 147554 - DNA, 698 bp, Homo sapiens
  misc_feature: GYAE6OF02HTW3F.21.86.H09.1.454.CMB.1.raw
  modified_base (178)..(178): a, c, t, g, unknown or other
  misc_feature (178)..(178): n is a, c, g, or t
  modified_base (188)..(188): a, c, t, g, unknown or other
  misc_feature (188)..(188): n is a, c, g, or t
  modified_base (359)..(359): a, c, t, g, unknown or other
  misc_feature (359)..(359): n is a, c, g, or t
  modified_base (613)..(613): a, c, t, g, unknown or other
  misc_feature (613)..(613): n is a, c, g, or t
tcagtcgtcgctcgcacgaccggtgctcgatttagtgctatagacttgggtttgggggccagggtgtggtttcctgtttaaatgtagcctccccgctgcagaattgcagacgcctgctagaattcgtggctgaccgagggcagtcaccagagctccagacatgtctgtctccttcctntactcttccncgcccgtagtcggccctccgagtcggggtctccgtgtcgacaaatacgagtctgacagcgaccggttcccggtacagggtacgtggggtcgaaccgtcccgtcggacaaccgtccctctaccacctccaccgtgcgactacgtccggacgggagtagtactttcgtttacnccaaccctagttaacgttagttaggtaagttcggactcggacgtccgtaccggttccccggtagaccgggacggttccgttaggacgggtcggcggttaaggggacgtactaccgtttacgtacgacggtactaaggtagttacggttattacgtagttaacttcgtacgaccgttaggttccgtgtaggtagaggtaacggtacggaagtcgactataccgacttacgaacccgtaaccgaaacgtagtaacncgtttactacccttccggtatccgttacgttccgaccttaccggttacgtaccggtaccgtaacccgtaccggaaccggtaccgg

SEQ ID NO: 147555 - DNA, 730 bp, Homo sapiens
  misc_feature: GYAE6OF02H8CD9.21.86.H09.1.454.CMB.1.raw
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgcccgtactgggccctcccatggggtntcctgtcgacaaatacagctgcagcagtccggtccaggactggtgaacgccctcgcagacccctctcactcactgcganactcgtccggganagtattctttancacctactagtacttaggaattggatcgaggcctacgtccccgtgacggtacggtccttaggacggttcggacggttagggggaacggtacctacgttttaccgtaacgtacgggttacccgtaaaggtacgttagggtttaactttacgttaggttaactttacgtaggtacccgttaaggtttcggttacgttagggttaggtaaacggtaaaacgggtttaccggtaaaagttacggggaacctaacgttaccgtaaaccttaaaccgaaccggtaaaccccgaaccggtaaagtaaccgttaccgtaaccgttttacccctcccggttacgtaccgttaacgtttttccggaccgttaccttacggttaccggttacccgtacccggtttaccccccggaaggtaaccccgg

SEQ ID NO: 147556 - DNA, 724 bp, Homo sapiens
  misc_feature: GYAE6OF02HUUYG.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccaagacaatgtctgtcctccttcctcattcttcctgcccgtactgggccctcccagtggggtgtcctgtcgacaaatacgagctgcagcaggtccggtcaggtactggtgacgccctcgacacgacccctctcacctccaccgtgaccgacctagtccggtaccggggagtagttacttcgtttacacctaccgtacttagttacgttggtaacgttggactcgacggccaccggttccccggtaggacgtacggtccgttaggtagggtcggtacgtagggggaacgtacgacgttacgtacgtacggtaccgaaggttacggtggttacgttcgtacgtaagttcgtacggacttaggttcggttcgtagggttaggaacggtaacgtaacggttaaacgtcgggtaccacgttaaccaaccgttaaccgaaccggaaaccccgaaccgtaagtaaccgttaccgtaaccggtttacccgtcccgttaaccgttacttcgttttaccgtaccgttaccgttaccggttacggttacccgtaacccggtacccggttaacccggtaaccgg

SEQ ID NO: 147557 - DNA, 573 bp, Homo sapiens
  misc_feature: GYAE6OF02G16UD.21.86.H09.1.454.CMB.1.raw
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtntcctgtcgacaaatacagctgcagcagtccgtccaggctggtgaagccctcgcacgaccctctcactcacctgcgacatcgtccggganagtactctttancaccactagtacttggaattggactcgacggctacgtccccgtagacggtacggtccttggagtggtcgtaggggaacggtactagttactacgaggtacccagtagtaggttacttcgtagtatttagtgtcgtaggtcgtcgtgtagaggtagtacgaagtggactacgtcaactacacgacccgaacgaanactactacgtttccnccgtagtctacgttcgacttactcgttcgtacgtaccctccgacgtacccg

SEQ ID NO: 147558 - DNA, 225 bp, Homo sapiens; identical to SEQ ID NO: 147476
  misc_feature: GYAE6OF02HLDSB.21.86.H09.1.454.CMB.1.raw
  modified_base (220)..(225): a, c, t, g, unknown or other
  misc_feature (220)..(225): n is a, c, g, or t

SEQ ID NO: 147559 - DNA, 231 bp, Homo sapiens
  misc_feature: GYAE6OF02JIJKO.21.86.H09.1.454.CMB.1.raw
  modified_base (213)..(213): a, c, t, g, unknown or other
  misc_feature (213)..(213): n is a, c, g, or t
  modified_base (219)..(231): a, c, t, g, unknown or other
  misc_feature (219)..(231): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactactccctcgtctctactgagcgggctggcaaggcncatagnnnnnnnnnnnnn

SEQ ID NO: 147560 - DNA, 623 bp, Homo sapiens
  misc_feature: GYAE6OF02GK32N.21.86.H09.1.454.CMB.1.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (465)..(465): a, c, t, g, unknown or other
  misc_feature (465)..(465): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccatggggtgtcctgtcgcaaatacagctgcagcagtccggtccaggactggtnaagccctgcagacccctctcactcacctgcgacatcgtccgggganagtacttcttttatccaacctacttagtaccgttaggaacgttggacttcgaggccgtacggtcccccgtgacggacggtccttaggtagtcgggctacggggaaggtacctattaccgtacgacgggtaccaggtaagttgggttaacttccgtagtatttagngcgtaagttcgttctggtagacgtaaggtcgaagtcggacagttaccaactaaccgaacgaaccccaacggaaacgaacgtccgtaacgtttcctacccgtagtacctagtttcgactaccgtcgttacggtccgtaccgtacccggacgtaacccgg

SEQ ID NO: 147561 - DNA, 693 bp, Homo sapiens
  misc_feature: GYAE6OF02IKSDB.21.86.H09.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (251)..(251): a, c, t, g, unknown or other
  misc_feature (251)..(251): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttccngcccgtacgtggccctccagtgggtgtcctgtcganaaatcngctgcagcagtccggcaggactggtnaacgcctcgcacgtaccctctcactcaccgtgccgacattccggaccggggtagtacgttaacttcttttacacctaccctaatacgttacgtttaggaatttcggatacgacggcctacggtccccgtgtacggacgtccgttaggacggttggacggtaggggaaacggactttacgttacctaacggtacggtaccgtaaggtagtttacggttactttaccgttaggtaactttaagtcggtacgtaagtttcgtacgtcggtaggtaacggtaaggttacgtaacggtagtacctagtacctaacgtacccgaacgaacccgtaacgtaacgtaacgttcgtaaccgtttcccgtacccgttaggcctttaacgttccgacccttacgttacggtccgttaaccggtaccccgttacccggaacggttaaccccggg

SEQ ID NO: 147562 - DNA, 811 bp, Homo sapiens
  misc_feature: GYAE6OF02I1VDJ.21.86.H09.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtctcctgtcgacaaatcagctgcagcacggtcccggtccagggactggtagaacgcccctcgccacgtacccctctccacctccacctgcgacacgttccggccgggggtagtagttacttccgttttaacnccctaacctaacgttacgttaaccgtttgggtaaactttgggaacttccggaacggtccgtaaccggtcccccggtaggacggtacggtccgtttaggacggttcgggaccggttagggggaaacgtaccgtttaacgtttccgttaacggtaaccgggtttacccgaaaggttaacgggtttaccgggtttaaacttttccggtaggttaaacgtttttacggtacgggtacgttaacgggtttggttttacccggtttagggttaacgggtaacggttaaacgggttacgggttaaacgttacggggtaacctaacgttaccgtaaccgtaaacccgtaaaccggtaaacccccgtaaacggtaaaacgtaaccgttaccgttaaccgttttaccccgttccgttagtaccttacgtttacgtaccttacgttcgttacgttccgtaccctaccggtaccgtacccgg

SEQ ID NO: 147563 - DNA, 228 bp, Homo sapiens
  misc_feature: GYAE6OF02GDSKW.21.86.H09.1.454.CMB.1.raw
  modified_base (220)..(228): a, c, t, g, unknown or other
  misc_feature (220)..(228): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaaggactacttccctgtctctactgagcgggctggcaaggcgcatagnnnnnnnnn

SEQ ID NO: 147564 - DNA, 628 bp, Homo sapiens
  misc_feature: GYAE6OF02F7KV2.21.86.H09.1.454.CMB.1.raw
  modified_base (211)..(211): a, c, t, g, unknown or other
  misc_feature (211)..(211): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtntcctgtcgcaaatacagctgcagcagtccggtccaggactggtgaacgcccctgcacgaccctctcactcacctgcgacagtcgtccgggganacgtatctttanccacctacttacgtacttggtaattggatcgaggcacgtccccgtgagacggtccttggacgtggcgttaggggaacgtactacgttcgtacgtacggtaccctaagtacgttagggttactttacgttaggtaactttagtcgtacgtaggttgttaccgttggtagtaaggtaacgtcgtaaaggtcggaactacttacgaactaacgaacgaccccgtaagaacgtaactcgtaccgttcgtacccgtcgtacttaacgtttcgaccttacgttcgttacgtaccggtacccgtacccgacgtaaccgg

SEQ ID NO: 147565 - DNA, 838 bp, Homo sapiens
  misc_feature: GYAE6OF02HRCME.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctcgcccgtacgtcgggccctcccgagtggggtcgtcctgtcgacaaatacagctgcacgcacggtccggtccaggtacgtggtgaaccgcccctcgacacgacccctctccacctccaccgtgaccgacctacgtccggtaccgggggagtaacgttactttaccgttttaactaccgtaaccctaacgttaacggttaccggtttagggttaaacgtttcgggtacttaccggaacgggtcccgttacccggggttacccccgggtacggaacgggttaccgggttacccgttagggtaacgggttcggggtaaccggttagggggaaaaccggtacgtaaccgttttaccgtaaccggtaaccgggttacccgtaaagggttacggttagggttactttaccgtaggttaagtttacgtacgttacggtacggttttgtaccggttggtaacgggtaacggttaaacggttcgggtaaacgttacgggaacctaacgtaccgtaaaccgtaacccggtaaacccggaaaccccggtaaaccgtaaacgttaacgtaccgttaccgttttaacccgtcccgttaggtaccttacgtttaccgaaccttaccgttcgttaccgtaccggtaccccgtacccgtaccgtaacccgg

SEQ ID NO: 147566 - DNA, 231 bp, Homo sapiens
  misc_feature: GYAE6OF02FWLLA.21.86.H09.1.454.CMB.1.raw
  modified_base (219)..(231): a, c, t, g, unknown or other
  misc_feature (219)..(231): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtcaaggactacttccctgtctctactgagcgggctggcaaggcgcatagnnnnnnnnnnnnn

SEQ ID NO: 147567 - DNA, 801 bp, Homo sapiens
  misc_feature: GYAE6OF02HY7CL.21.86.H09.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgccgtactgggccctccagtgggtntcctgtacgactaaatacagctgcgacgctacgtcccggtcgaggtacttggttggaaccgcccgtcgacctacgtacccctcgtacctaccgtacctaccgttcgaccgtacctagttacccggtacccgggggtaagtacgtttactttccgttttactacctaaccctacgtttaacggtttaacgttagggtaaacgtttgggacttacggacggtaccctaccggtacccccggttaggacggtacggttaccgttttaggacgggttcgggaccggttaaggggtaacgtaccgtttacgtttaccgtaacgacgggtacctaggttgttaacggttcgtttacgacgttatttacgtacggacttaaggttcgtacgttagggtacgtaaggtaacgttaggaaacgttcggaaccttaacgtacctaaccgttaacgacccggtaaacccgtaaacgaacgttaaccgtaccgttacggtttaccccgtcgttaacggtacgtttaacgtttacgacccgtttacgttaacccggtttacggttacccccggttacccgtaccccgggtaacccgttaacccggg

SEQ ID NO: 147568 - DNA, 707 bp, Homo sapiens
  misc_feature: GYAE6OF02GW6YM.21.86.H09.1.454.CMB.1.raw
  modified_base (212)..(212): a, c, t, g, unknown or other
  misc_feature (212)..(212): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtntcctgtcacaaatcagctgcagcacgtccggtcaggactggtacgacgccctcgcacgtacccctctccactccacctgaccgactacgtccggtaccggggatacgttacttctttacaccaacctaacgttacgtacgtttaggtaacgttggaacttcgacggtccgtaccgttcccggtacggagtacggtccttagggtagtcgggtcggtaagggaacgtacctagttaccgtacgacggtaccaggtagttacggttattcgttagtaactttgacgtactaggtttgtacgttggtagtaacggtaaggtacgtaagtacggaactacgtacctaacgtacgtaaccgtaaacccgtaacgtaacgtacttacccggttacgtttacccgtcccgttaacgttaccgtttaactttacccggtaccttaaccgtttccggttacgttaacccggtaaccccgttacccgggtaacgttaaccccggg

SEQ ID NO: 147569 - DNA, 567 bp, Homo sapiens
  misc_feature: GYAE6OF02G5740.21.86.H09.1.454.CMB.1.raw
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgccccgtactcgggccctcccgagtggggtgtcctgtcgcaaaatcagctgcagcacggtcccggtccaggactggtgaacgccctcgcacgacccctctcactcacctgcgacatccgtaccggggagacgtattctttanccacctactagtacttggaattggactcgaggcacgtccccgngagcgctgagtggcgtagggaacgtactagttaccgacacggtccaagtagtggttatcgtagatttangtcagttgtntggtagaggtacgtagaagtgacatactactacgaaccgaacccaacgaataactgtaccgttacctccgtagtactactttcgaccgtacttcgttagtcgtacccaccgacgtaccg

SEQ ID NO: 147570 - DNA, 799 bp, Homo sapiens
  misc_feature: GYAE6OF02IMELL.21.86.H09.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtacgtcggccctccagtggggtntcctgtcganaaatcagctgcagcgagtccggtcaggctggtagaacgccctcgcacgcccctctcactcacctcgaccgcacgtccggtaccgggggaagtacgttactttctttacaccgaacctaacgttaacgttacgtttagggtaaatttcggattaccgacggtccgtaccggttacccccggtacggaacggttaccggtcgttttagggacgggtttacgggacgggttaacgggggaacggtaaccgtttaacggtttccgttaaaccgggtaccgggttaaccggtaaaggttaacggtttacgggtttaaacgtttcgttacggttaaagttttacgtcgtaccggttggttacggtttccggttaggttagggtaaacgtaaggttcggaaaacggttcgggtaacctaacttaccgaacccgttaaaccgtaaccccgggaaacccttaaacccgggaaacgttacgttaccgtttaacctttcccgtacccgttacgttacctttaggtttaccaccgtttaccgttcgttaccggttaccggtaacccccggtccggaaccgtaaccccgg

SEQ ID NO: 147571 - DNA, 710 bp, Homo sapiens
  misc_feature: GYAE6OF02GOCC5.21.86.H09.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccatggggtcgtcctgtcgcaaatacagctgcagcagtccggtccaggactggtgaacgccctcgcacgacccctctcactcactcgcacatcgtccgggganagtatctttatccactactagtacttggaattggatcgacggctaccggtccccgtacggagtacggtccttggaggtcgggtccgtagggggaaacggaccttaagttaccgtaccgacgggtacccaaggtacgttacgggttaactttcgtaggttaactttaacgtcgtacgtaggttcgttcgttaggtaggtacggtaaagggttacgtaaaggttacgggaaccttaacgttacccgtaaccgttaaccgtaaacccggaaaccccgaaaaccgggtaaacgtaaccgttacccgttaaccgtttaccccgttaccccgtacgttaccttaaccggtttcgtacccgttaccgttccgttacggttaccgtacccgttaccccggaacggtaaccccgg

SEQ ID NO: 147572 - DNA, 712 bp, Homo sapiens
  misc_feature: GYAE6OF02FNJ9H.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactggcctccatggggtgtcctgtcgcaaatcagctgcagcacgtccggtccaggactggtcgaagccctcgcagaccctctcactcacctgcgacatccgtccggggagtaagtatcctttaatccacctacttagttaccttgggaatttggaacttcgacggtcacggtcccccggtagacggacggcccttaggacggtgggtccgtagggggaaacgacgtaagttcccgttaacgtacgggtcccgaaggtattacgggttaacgtttctttgtaagtttagtcggtacgttaggtttaccggttcgttaggttacggtaaggtaaacggttaccgtaaaggttacgggaactagttaaccgtaaccgtaacgaacccgtaaacccgaacccggtaaacgtaaccttacgtaaccggtttacccgttacccgttacggttaccgtaacgttttcgaacccgttaccttccgtttaccggtacggtaccccggttaccccggtaccggtaaccccgg

SEQ ID NO: 147573 - DNA, 566 bp, Homo sapiens
  misc_feature: GYAE6OF02FLZX4.21.86.H09.1.454.CMB.1.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (494)..(494): a, c, t, g, unknown or other
  misc_feature (494)..(494): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtgtcctgtcgcaaatacagctgcagcacgtccggtccaggactggtagaacgccctcgacacgaccctctcactcacctgcgacngtcgtcggganagttatctttancaccactagtacttggaattgatcgagctacgtcccgtgacggcgtctgagtggcgtagggagtactactcgtacgaggtccgagtagtggttattcgtagtattagtgtcgtagtgttacgtggtagagtaacgtcgtaaagtggacctagtaccactaccgacgaccaacgaanactacgtacgtcctccgtagtacttacgttcgaccgttacgtcgttacgtacggtaccctaccgacgtaccg

SEQ ID NO: 147574 - DNA, 602 bp, Homo sapiens
  misc_feature: GYAE6OF02JRGFI.21.86.H09.1.454.CMB.1.raw
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (382)..(382): a, c, t, g, unknown or other
  misc_feature (382)..(382): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggccctcccagtggggtctcctgtcgacaaatacagctgcagcacgtccggtccaggctggtagaacgccctcgcacgaccctcgtcacctcaccgtgaccgacagtccgtacgggganagttacttcgtttaacnccaacctacttacgtacttaggaattggactcgaggcctacgtcccgtgagnggtacctggagtcggcgtagggagtctattcgacgaggtaccagtactggttattcgtagtacttaagcgtcgagttgtcgtacgtggtaacgtaggtactaagttcgggaactacgtacgtaacgtacgaaccgaacccaaccggtaagactacgtagtcccgtacgtcgtactacgttcacgtacgttccgttagaccgtaaccgtccgaccgtaccg

SEQ ID NO: 147575 - DNA, 683 bp, Homo sapiens
  misc_feature: GYAE6OF02HM84A.21.86.H09.1.454.CMB.1.raw
  modified_base (214)..(214): a, c, t, g, unknown or other
  misc_feature (214)..(214): n is a, c, g, or t
  modified_base (338)..(338): a, c, t, g, unknown or other
  misc_feature (338)..(338): n is a, c, g, or t
  modified_base (441)..(441): a, c, t, g, unknown or other
  misc_feature (441)..(441): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctcgcccgtactcgggccctcccagtggggtntcctgtcgacaaatacagctgcagcacgtccggtcaggctggtcgaacgccctcgacacgaccctcgtccacctcaccgtgaccgactacgtccggtaccggggataacgttacttactttacncctaacctactacggttactttacggaatttaggactacgacggtcctacgtccccggtagacggtacggtccgttaggaggtcggtacgtaggggaaacgtntacgttactaacgtacggtactaacggtagtacggttaattcgtagtacttagtcgtaaccgttagtttccggtagttggtacgaagggtaaccgttacggtaacgttacggaacctactaccgtaaccgtaaccgaccggaaacccctaaacggaactaaccgtccgtaacgttccctaaccgtgtacctagtttcgaacctaccgttcgtacgtacccgtacccgtacccgaggtaaccg

SEQ ID NO: 147576 - DNA, 733 bp, Homo sapiens
  misc_feature: GYAE6OF02HM71N.21.86.H09.1.454.CMB.1.raw
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccagacaatgtctgtctccttcctcatcttcctgcccgtactcgggccctcccgagtcggggtcgtccgtgtccgactaaatcagctgcagcgacgtccggtccaggtacgtggtacgaacgccctcgacacgaccctctaccactaccaccgtgacgactacgtccggtacggggatacgttaacttcgtttacaccacgttaactacggttacgttaggtaagttcggactacgaggtcctaaccggtccccgtaggacggtacggtaccgtttaggacggtcgggacggttaacggggaacggtaccttacgtttaccgacggtacggtacctaaggtacgtttaggttacttacgttacgttaagttacgtaccggtacgttacgtttacgttacgttagggtaggtaacggtaaggttaacggtaaggtaccggacttacgtacctaacgtaaccgaaccggaaacccaacgggtaaactaaccgtcctttaacggttccccttaaccgtacgttacccgttgtttaccgcctaacgttcggtacccgttcggaacccgtcccggaacggtaacccgg

SEQ ID NO: 147577 - DNA, 654 bp, Homo sapiens
  misc_feature: GYAE6OF02H1WEK.21.86.H09.1.454.CMB.1.raw
  modified_base (261)..(261): a, c, t, g, unknown or other
  misc_feature (261)..(261): n is a, c, g, or t
  modified_base (332)..(332): a, c, t, g, unknown or other
  misc_feature (332)..(332): n is a, c, g, or t
tcagtcgtcgctcgcacgaccggtgctcgatttagtgctatagacttggggtttgggggcccagggtgtggtttcctgtttaaatgtagcctcccccgctgcagaattgcagagcctgctgaattctggctgaccagggcagtcaccagagctccagacatgtctgtcctccttctctatcttcctgcccgtactcgggccctcccagttggggtctcctgtcgacaaatacagctgcagctagtccggaccaggactggngaacgccctacgccacgcccctctaccactaccacctgcgacatccggtcggggagtagttacttcttacnccacctacgttagtacgttggaattggatcgacggtacctacggtccccgtaggagtacggtccttggagttcggacgtacggggaactacgtacgttcgtacggtacgtaccgaggtagtacggttagttacgtagttaattgtacggtcgttagttcgttcgtagttacggtaagtaacggtacggtagtacggtactaacgttacctaacgttaacgaacccgacccgtaacgaagtaacttcgtaacgttccgtacctgtaccttcgttacgtacccgttacgttccgtacggtaccgtaccgtacccgagtaacccg

SEQ ID NO: 147578 - DNA, 701 bp, Homo sapiens
  misc_feature: GYAE6OF02HRORP.21.86.H09.1.454.CMB.1.raw
  modified_base (310)..(310): a, c, t, g, unknown or other
  misc_feature (310)..(310): n is a, c, g, or t
tcagtcgtcgctcgcacgaccggtgctcgatttagtgctatagacttgggtttgggggccagggtgtggtttcctgtttaaatgtagcctccccccgctgcagaattgcagagcctgctgaattctggctgaccagggcagtcaccagagctccagacaatgtctgtctccttcctcatcttcctgcccgtacgtgggccctcccgagtggggtcgtcctgtcgacaaaatacagtctgcagcgtacgtcccggtaccagggactggtgaacgccctgccacgacccctctaccactccacctgccgacncgtccggaccggggatacgttacttctttacaccacctacgtagtacgttaggtaagttggactcgaggccgtacgttcccgagaggtacggtccttagggagtcgggacggtagggaacggtactaacgttccgtaacgacgggtaccaaggttagtacgggttaacttcgtaggttaacttagtcgtacgtagttggttacttggaaggtaagtaaggtactaaggttacggtacacgtacctaaccgttaaccaccggtaaacccgaaaccgtaagtaaccttccgtaaccgtttcccgtcccgttacggtaccttaacgtttaccgccgttaaccccgtttaggtcggttaacccggtaaccccgttaccccgtaaccggtacccgg

SEQ ID NO: 147579 - DNA, 796 bp, Homo sapiens
  misc_feature: GYAE6OF02JO007.21.86.H09.1.454.CMB.1.raw
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
tcagtcgtcgctcgcacgaccggtgctcgatttagtgctatagacttgggtttgggggccgagggtgtggtttccgtgtttaaatgtagcctccccgctgcagaattgcagagcctgctgaattctggctgaccagggcagtcaccagagctccagacaatgtctgtctccttcctcatcttcctgccccgtactggggcccttacccagttcgggggtcgtccctggtaccgcaaaataccaggtcctggccagcacggttccggtaccaggtactgggttagaacgcccctggaccacggtaccccttcgtccaaccgttccaccgtcgaccgaacacgtccgtccgggganagttacttcgtttacnccactacgtaacgttacttacgggaatttggacttcgaggacctacggtccccgtgaggtacgccgtttaggacgttcggacgttcggggaaacgtactacgttaccgtacgtaacgtaccgtaagtacgttaggttacgttacgttaggtaactttacgtacggtacgttaagggtttcgtttaccggtaggttaacgggtaaaggttaaccggttacggtaaacggtttacgggtaacctaaccgttaccggtaacccgttaaaggtaaccccgtaaacccggtaaaccgtaaacggttaaccttacggttaaccgtttacccgttaccccggtagttacccggttacgtttaaccggttccgttaacccgtttaccggttccggttaacccgttacccggtttaccccggaacggttacccgg

SEQ ID NO: 147580 - DNA, 685 bp, Homo sapiens
  misc_feature: GYAE6OF02H1IKU.21.86.H09.1.454.CMB.1.raw
  modified_base (371)..(371): a, c, t, g, unknown or other
  misc_feature (371)..(371): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccgagggtcgtcgtcgtcgcaaataacacgcgtcgcgacgacgacgtccggtaccgacgacgtacggtggaacgacccgtccgcacgacccgtcctcacctctcctcgcgacactcgtccgggacggagtagtctttactacaccactagtacgttaggtagtagtacgtntacgcgtacgtcccgtcgaggacgtcgtggtagtggcgtagggacgggtaactacgtttcgttaaccgtacgggtacctaacggtaagtttcggttactttcgttacgaaagtttatcgacggttaggttcgttacgttgtacgggtaaagaggttaacgttaaggtcggtaacacgtaactaccgtaacgaaacccgtaaccccaacggttaaagaacttacctaccgtttacctcccgtagttccctaagtttccgactacccgtacgtttacggtaccgtaccccgtacccggtaccgtaacggtacccgg

SEQ ID NO: 147581 - DNA, 650 bp, Homo sapiens
  misc_feature: GYAE6OF02H8FJP.21.86.H09.1.454.CMB.1.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (407)..(407): a, c, t, g, unknown or other
  misc_feature (407)..(407): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagagctccaagacaatgtctgtctccttcctcatcttcctgcccgtactgggccctcccagtggggtcgtcctgtcgacaaatccagctgcagcagtccgtcaggactggtgaacgcccgtcgactacgacccctctacacctcacctcggacacnctacgtccggggagtagtacttctttacnccactactagtacgttagaattggactcgacgctacgtcccgtagacgtacgtcgttaggacgtgacgtagggaacgntacgttactacgacggtaccagtacgttaggtacttcgtagtattaagtgtaccgtaggtttacgtcgttagtaggtaggtaaacggtacgtaagtacggtactaaccttcgaaaccgttaacgaaccgaaacccgaaaccgaacgttaacgtaccgttaccgtttacccgtccgttcgtactacgttttaccgtcttaccgtcgttaccgttaccggaaccctttcccggaacgttacccgg

SEQ ID NO: 147582 - DNA, 758 bp, Homo sapiens
  misc_feature: GYAE6OF02IIPKR.21.86.H09.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtntcctgtcgacaaatacagctgcagcacggtcccggtccaggactggtgaacgccctcgcacgaccctctacactcacctgacgacacgtccgtaccgggggagtagtattctttaactcaacctacttagtacgtttaggtaacgttggactcgaacggtccgaccggtcccccggtacggacggtacgggtacctttaggagggtcggggtacggttaggggggaacgtacgtttactttaccgtaaaccggtcgggtaccctaaggtagtttcggtttaaatttcggttagaacttttagtacgtacgtaacggtttgttaccgttaggttaacggtaaggtaaacgggttaccgtaaaggtacgggtaacctaacgtaccctaacgtaaaccgtaaccggaaacccccgtaaaccggaaacgtaaacgttacccgttaacggtttcccccgttacccgttagttacctttaacggttttacccgacgttacccttccggttaggtaccccgttaaccccggtaccccgggtaccgtaacccggg

SEQ ID NO: 147583 - DNA, 672 bp, Homo sapiens
  misc_feature: GYAE6OF02HQ6ZG.21.86.H09.1.454.CMB.1.raw
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcctcctgcccgtagtcggccctccagtggggtctcctgtcgacaaatacagcctgcagcacggttcccggcaggtacgtgggtcgaacgcccctcgacaacgtcccctcgtccacctccaccgtcggcaactcgtccggtaccggggatagtacttctttacnccgaactatacgtacgtgtatggatcgagccgtacgtcccgtagaacggtcgtcgttaggngtcgggaggtaacgggaacgtacttacgttcgtaacggtacgtaccgaggtagttcggttacttgtacgttaattacgtcgacgttaggttcgttcgttaggtaacggtaagtaacggtcgtaaacgtacggtaactacggtacctaaccgttaccgaaccgtaacccgtaaacggaactaaccgttccgttaccgttaccgtccgttacgtccgttaagttccgtactacgttctacggtacccgttacccgacccgacggtaacccgg

SEQ ID NO: 147584 - DNA, 791 bp, Homo sapiens
  misc_feature: GYAE6OF02GO0K5.21.86.H09.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagtgctatagacttgggttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcggccctcccagtggggtntcctgtcgacaaatacagctgcagcagtccggccaggacgtggtgaacgcccgtcgcacgtacccctctccactccacgtcgaccgactacgttccggtaccggggatacgttaacttaccgtttactacctaacccgtaacttacgttaaccgtttagggtaatttcgggtactaccgaacggtccgtaccggtcccccgggtagaacgggtacgggtacccgttagggtacgggtccgggtacgggttaacgggggaaaacggtacctaacgttttacccgtaacggtaaccgggttacccgaaggtaggtttacgggttaactttcgttaggtaacttttacggtacgtacgttacggtttacggttccgttagggttaacggtaaggttaacggtaccgggttaaagtaccggggtaactaaccgttaccgaaacccgttaaccaaacccgggttaaaccccgaaacccgtaaggtaaacccttccggttaaccgtttccgtcccgttacgtacgttacgttacccgtacgtaccgttccgtagttacccgtacccggttacccgaagtaccccgg

SEQ ID NO: 147585 - DNA, 616 bp, Homo sapiens
  misc_feature: GYAE6OF02GB7IH.21.86.H09.1.454.CMB.1.raw
  modified_base (211)..(211): a, c, t, g, unknown or other
  misc_feature (211)..(211): n is a, c, g, or t
  modified_base (327)..(327): a, c, t, g, unknown or other
  misc_feature (327)..(327): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcggcctcccagtggggtntcctgtcgactaaatcagctgcagcagtccggtaccgaggtactggtgaacgccctcgccagtacccctctcaccttcacctgccgacagtccgtccggggatagtattctttacnccacactagtacttgaattgatcagncgtcccgngancggtcttgagtgcgtagggaacgtctacttctacgtacggtacctagtagttgttacttcgtagtacttagtcgtacgtagtcgtacgttgtcgaaggtaacgtacgtaagtacggactaacgtcctaactaccgaaccgacctaacccggtaaagtaaccgttacctaggtttaccccgttccctacggtactttacgttcgtacctaccgttacttccggttaccctacccgtaccccgtaccgaacccg

SEQ ID NO: 147586 - DNA, 759 bp, Homo sapiens
  misc_feature: GYAE6OF02GN6VF.21.86.H09.1.454.CMB.1.raw
  modified_base (211)..(211): a, c, t, g, unknown or other
  misc_feature (211)..(211): n is a, c, g, or t
  modified_base (320)..(320): a, c, t, g, unknown or other
  misc_feature (320)..(320): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactgggcctcccagtggggtntcctgtcgcaaatacagctgcagcaggtccggtccaggactggtgaacgcccctgcacgaccctctcactcacctgcgacagtcgtccggggatagtacttcgtttacncacctacttagtacgttacggtaattcggatcaggtcaccgtccccggtaggaggtacggtcctttgggaacgtcggggacgtaggggaagtactacgttcgtaacgtacgggtaccagggtacgttagggttaactttccgtagttaaacgtttacgtacggtaccgttaggttcgtttacgttagggtaggtaaacgggttaaacgggttaccggaaaggttacggggttaacctaacgtttaacccgtaacggtttaaacccgaacccgggtaaacccccgtaaaaccgggtaaacgttaaaccgtttcccggttaacgttttaccccgtttccccgttaacggttaacccgttaacgttttacccgacccgtttaaccgtttccggttaaccggttaccggtaaccccgttaccccgggaacggttaaccccggg

SEQ ID NO: 147587 - DNA, 685 bp, Homo sapiens
  misc_feature: GYAE6OF02ICE5J.21.86.H09.1.454.CMB.1.raw
  modified_base (675)..(675): a, c, t, g, unknown or other
  misc_feature (675)..(675): n is a, c, g, or t
tcagtcgtcgctcgcacgaccggtgctcgatttagtgctatagacttgggtttggggccagggtgtggtttcctgtttaaatgtagcctccccgctgcagattgcagagcctgctgaattctggctgaccaggcagtcacagagctccagacaatcgtctcgtcttcccttcctcattccttcctcgcccgttacgtcggccctcccgagtcggggtctaccgtgtaccgataaaactcagctggcacgtcgcgtccgctaggacttggataacgtccctcgccacgtcccctcgtcacctccacgtcgactacgtcgtcggtaccggggtatacgttactttcgtttacaccgtacctaacgttagtacgttaggtaacgttggtaacctcgacggtaccctacggtaccccgtaggacgtacggtccgttagggtaccgggtacgtacggtaacgggacgtacttacgttaccgacgtaacggtcgtacgtagtggttctagtagttacttagtacgcgttagtcgttcgtacgtgtaacgtaggtacgtagtaccggtaataccggtacctaagtaacccgaacgtacccgtaaacggtattaactccggttaactccggtaacctcgtaaacttcgttaccgatcgttaccgtgtaacccggcctaccggngttaacccgg

SEQ ID NO: 147588 - DNA, 261 bp, Homo sapiens
  misc_feature: GYAE6OF02H2UM4.21.86.H09.1.454.CMB.1.raw
  modified_base (224)..(261): a, c, t, g, unknown or other
  misc_feature (224)..(261): n is a, c, g, or t
tcagtcgtcgctcgcacgaccggtgctcgatttagtgctatagacttgggtttggggccagggaaccctagtcaccgtctcctcagcctccaccaagggcccatcggtcttcccctggcgccctgctccaggagcacctccgagagcacagcggccctgggctgcctggtacaaggacttaccttccctcgtctctactgagcgggctggccaaggcgcatagnnnnnnnnnnnnnnnnnnnnnnnnnnnnnnnnnnnnnn

SEQ ID NO: 147589 - DNA, 739 bp, Homo sapiens
  misc_feature: GYAE6OF02JU9QF.21.86.H09.1.454.CMB.1.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
tcagtcgtcgctcgcacgaccggtgctcgatttagtgctatagacttgggtttgggggccaggtgtggtttcctgtttaaatgtagcctcccccgctgcagaattgcagagcctgctgaattctggctgaccaggcagtcaccagagctccagacaatgtctgtcctccttcctcatcttcctgacccgtctcgggcctcccagtggggtgtccgtgtacgcaaagtacagctagcagcagtccgtcagactggngacgccctgcagaccctcncactccactcgaccgtacaactcgtacccggggagtaacgtacttactttactaccacccgtacgtaacgtaccgttaggtaacgtttaggaacttccggaacgtcccgtaaccggtttaccccccggagtaaccggtaccggtacccgttttgggacggttacggtaccgggtaacgggggtaaacgtacgtacgtttacctaacggtacgtaccgtacgtaagtacggttcttaccgaggttattaacgtcgtcgtaagtttcgttacgttcggtacgtaaccggtaaaggttacgaacggttagaaccgttaccgtaaggtaacccttaacggaaaaccccgttaccgacccgaaaagttaccgtacgttacccggtttaccctcccgggttactaacgttcggtttaacctacttaccgtaccgttcgtaacgtaccccggttacccgaacgtaaccccgg

SEQ ID NO: 147590 - DNA, 791 bp, Homo sapiens
  misc_feature: GYAE6OF02GY8H9.21.86.H09.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtatcgggcctccagtgggtcgtcctgtccgacaaatacgagctgcagcgtacgtcccggtcgaggtacgtcggtagaacgtccccgtacggccacgtaaccccttcctccaccttccaccgttgaccgacctacgtcggtaccggggtataggttaccttcgtttactcccaacgtaaccgttagttaccgttaggaacgtttcggtaactaccgacggtacccgtaccgggttaacccccggttcggaaggtacccgggttacccgtttaaggacggggttacggtcgggtaaacgggggtaaaccggtaaccgtttaacggtttacccgtaaccgggtaacgggttaccctaaacggggttaaagttcgggtttaacttcgttacgttaacggtttaaccgnggtaccgttaaggtttccgtcggttacgttaaggtaaacgtaacggttacgtaaaggtcgtaaacttcaccgttaaacaccgtaaccgaacccgaaacgtaacggttaacctacgtttaccgtaccttcccggtaagttaacctttacggtaacgttctaacgttcgtaccgtccgaaccggtacccgtacgtaccgg

SEQ ID NO: 147591 - DNA, 739 bp, Homo sapiens
  misc_feature: GYAE6OF02IBBU8.21.86.H09.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagtgctatagacttgggtttgggggccagggtgtggtttcctgtttaaatgtagcctccccgctgcagaattgcagagcctgctgattctggctgaccagggcagtcaccagagctccagacaatgtctgtctccttcctcatctcctgcccgtactggccctcccagtggggtcgtcctgtcgacaaataccagtctgcagccagtccggtacaggactggtgaacgcctcgcacgacctcncactcacctgcacacgtcgtccggggagtacgtacttacctttactccaaccacgttacgtaccgttaggtaagtttggaacttcgaacggtcccgtaccgggttacccccggtaggacggtacggttaccgtagggtcggttacgggtacgggttacgggggaaacgggtaacttaactttccgttaaccgtacgggttaccctaaggttagtacgggttaatttcgtaacgttaatttaacgtggtacctacgggtttcgtcgttcggttaagggtacggtaaagtcggtaaagtacgggtactaacgttaccgtaacgttaacccgtaaccggaaccccgtaaacccgtaaacgtaaccgtaaccgtaccgttttcccgtacccgttagttccgtacgtttaccgtaccttacgttccgtacgttacccggtaccggtaccccggtaaccggtaacccgg

SEQ ID NO: 147592 - DNA, 708 bp, Homo sapiens
  misc_feature: GYAE6OF02HJX8W.21.86.H09.1.454.CMB.1.raw
  modified_base (570)..(570): a, c, t, g, unknown or other
  misc_feature (570)..(570): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatctcctgcccgtactcgggccctccgagttggggtcgtcctgtcgactaaatacagctgcagcagtccgcagacgtgagacgccctcgacacgaccctctacacctccaccgtgaccgactacgtccggaccgggggagtacggtacttcgtttactccgaaccctacgttaacggttaccgttagggtaacgttaggactacggtaacggtccgtaccggtccccggtaggaacgtacgggtccgtttagggacggtcgggacggtacggggaacggtacgttaacttccgtaacggtaacggtaccagggtaacgtttgggttacttcgttagtaagtttacgcggtataggtcgttacgtggtagaaggtacgtacgaaggtcgaacgtntaccgtaactaaccgaccgtaaacccgaacggtaacgtactaccgttaccgtttaccgtcccggttagtaccttagtttaccgaccgtttaccttcggttccggaaccgtaccccggtttacccggaccgttacccgg

SEQ ID NO: 147593 - DNA, 758 bp, Homo sapiens
  misc_feature: GYAE6OF02JYEQN.21.86.H09.1.454.CMB.1.raw
  modified_base (407)..(407): a, c, t, g, unknown or other
  misc_feature (407)..(407): n is a, c, g, or t
tcagtcgtcgctcgcacgaccggtgctcgatttagtgctatagacttgggtttgggggcccagggtgtggtttcctgtttaaatgtagcctcccccgctgcagaattgcagagcctgctgaattctggctgaccagggcagtcaccagagctccagacaatgtctgtctcccttcctcagtccttcctcgacccgtacgtcgggccctcccgagtggggtctccgtcgtaccgactaaaatcgtacgctagaccgacgtcgtacggttcccgggtacctaagggtaccgttgggacgaaccgtccccgtcggaccgaaccgtaccctttcgaccctactacccgtaccgtacggacctaactaccgttcccgggtaccggggaattacgttactttccgtttaaccnccgaaccttaacgttacgttacgttaggttaacgtcggtaactcgtaacggtcccgtaccggttccggtcggaacgggtacggtcctgggtaacgtcggtacggtaagggtaacgttactacgtttacgaacgacggtactaagtacggtttacgattttacggacttagttacgacgtggttaacgttcggttcacggttacgtaacgacggtacgtagtacgtacgtactacgaacgtaccgaaccgtaccgaaagtacgttaacgtccttaaccggttacccctggttacctgttaaccgtcgtaccgtattaccggtacgacccggtacctacccggactaaccggg

SEQ ID NO: 147594 - DNA, 665 bp, Homo sapiens
  misc_feature: GYAE6OF02GVUAV.21.86.H09.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
tcagtcgtcgctcgcacgaccggtgctcgatttagtgctatagacttagggggtttgggggccaggggtgtggtttcctgtttaaatgtagcctcccccgctgcagaattgcagagcctgctgaattctggctgccagggcagtcaccagagctccagacaatgtctgtctaccttcctcatccttcctgcccgtactgggcctccgagtggggtntcctgtcgacaaatcagctgcagcagtccggtcaggactggtnaacgccctcgacacgacccctacncgaacctcacctcgcgacatccgtcggggagacgtacttctttacgtacctaccgacgttacggttacgtcggtaattggtactcggacggccgtacgtcccgtacggaggtacggtaccgttgacggtcggaccggtagggaacggtacctagttccacggtacggtaccaggtattggtacttgtaggtattagtcgacttagtccgttagtggtaggaacgttaacggtacggtaacgttgggtaacctacgtaaccgtaacgtaacgtaaccggacccgtaaaacgaacgtaaccgttcgtaacgttccctccgttaagccttaacgttccgccgttaccgttgttcccgtaccggtaccctcccggtacgtaacccg

SEQ ID NO: 147595 - DNA, 820 bp, Homo sapiens
  misc_feature: GYAE6OF02JOG7A.21.86.H09.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttctcattcttccngcccgtacgtcggcctccgagtggggtctcctgtcgacaaatcagctgcagcacgtccggtaccaggactggtacgaacgccctacgcaccgtaccctctacgtactacctacctcggacctaacgtacgttaccgggtacccgggggaaatacggttaactttccttttaaccgaccccgtaaccgttaaccgttacgttaccgtttaggggtaaacgtttcggaagttaccggaaggtccccgtaaccggttacccccggttagggaacggtaccgggttacccgttttagggaacgggttccgggaacggtacggggtaaaccggtaccttacgttaaccgtaacgggtaccggttacgtaacggttaacttcgggttaaacgtttccgtaagttaacgtttacgtacggtacggttaacggtttccgtacggttgttaaacggtaacggtaacgggttaaccgtaaggtaccggaacgttacgttaaccgtaaaccgaccgtaaccgtaacccgaaacgggtaaattaccgttaccgttaaccggttcccttaacccggttaagtaccgttaacgtttaccgacttaccgtttggttaccgtaaccgttacccgtaccggaacccgttacgg

SEQ ID NO: 147596 - DNA, 557 bp, Homo sapiens
  misc_feature: GYAE6OF02JF17A.21.86.H09.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (419)..(419): a, c, t, g, unknown or other
  misc_feature (419)..(419): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacatgtctgtctccttctcatctcctgcccgtactcggcctcccagtggggtgtcctgtcgacaaatcagctgcagcacgtccggtcaggactggtcgaacgcccctcgacacgtaccctcgtcactcacctggcacacgtcgtcgggatagtntcttancactagtagtactgatgagtcgaggtcncgtccgngagcgtcgtgagtgcgtagggaacgtctatcgagtcgtacagtagtcgttattcgtagtaacttgtcgngttagtcgtctaggtagaagtacgttacgatacggactgtaccaccttacgaccgaaccgtacgaatagttccagttcccgtactgcttacgttcgacctacgttggtaccgtccgaaccgtaccccgagtaacccgg

SEQ ID NO: 147597 - DNA, 703 bp, Homo sapiens
  misc_feature: GYAE6OF02F11TW.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactcgggcctcccagtggggtgtcctgtcgacaaatcagctcgcagcagtccgtccagactggtcgaacgccctcgcacgaccctctcactcacctgcgactacgtcgtaccggggatacgtacttctttaacgtccaaccgtacttacggttaccgtttggaaagtttggtaactacgacgggtactaccgggtacccccggttacggaacgggtaacggtcccgtttagggtaacggtcggggtaccggttagggggaaaacgggtacctaacgttttacgtaaaccgttacgggtaacccgtaaggtaacggtttggtttaacgttccgtaaggttattaagtcgtaacggttacggtcgttagttcgggtagaaggtaacggttcgtaaagtcgggaactacgtacgtactaaaccgaccgtaacccgacgtaagaacttccgtaagttcccgtcctaggtcctagttctaccgtacgttctagtccgacctacccggtacgtacccgg

SEQ ID NO: 147598 - DNA, 616 bp, Homo sapiens
  misc_feature: GYAE6OF02GNUPW.21.86.H09.1.454.CMB.1.raw
  modified_base (211)..(211): a, c, t, g, unknown or other
  misc_feature (211)..(211): n is a, c, g, or t
  modified_base (303)..(303): a, c, t, g, unknown or other
  misc_feature (303)..(303): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatgtctgtctccttcctcatcttcctgcccgtactggccctcccagtggggtntcctgtcgacaaatacagctgcagcacgtccggtccaggtactggtagaacgccctgcacgaccctctcactcacctgcacatcgtcggganagtatcttatcaccatagtactgtattgatcgagcacgtcccgtgagacggtctgagtggcgtagggaagtactagttactacgtacggtacctagtagttggttacttctagtattacgtgtaccgtagttgttacgtggtagtaaggaacggttacggaagttacggtaacctactaccgtaactaaccgaaaccgtaaccccgaaaccgtaacgtaaccttacgtaccgtttaccctcccgtagtaccttagtttccggacttaccgttcgttaccgtaccgtaaccccgtacccggaaccgtaacccgg

SEQ ID NO: 147599 - DNA, 875 bp, Homo sapiens
  misc_feature: GYAE6OF02GZTMP.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccagggcagtcaccagagctccagacaatctcgtcgtcctccttcctcacttccttcctcgtacccgtacgtcggtccctaccgtaggtcggggtcttccgtcggtaccgaactaaaatccgacgtcgtcgacacgacgtacggtccggtcgaaggtacgtcggtacggaaccgtcccgtacggactaaccgtacccttctacctaacctccgtaccgtagacccgtaacgtaaccgttcccgggtaaccggggtaagtaacgttttaaccttaccgtttaacgtaccctaaccttaaacggttacgttaacggtttaacgggttaagttacggaacgtccgtaacggtcccgttaacccggtcccgggtaacgaacgggtttaccgtaccggttaggtacgggtacggtaacgggttaacgggaaacggtcctttaaaggtttaccggtaaccgtacgggtaccgtaaaggtttacggttacggttactttaacgtaggttatacggtacgtacgttaggttcgtacgttagtaacggaaggtaaggttaaccgtaggtaacgttaccgtacgttaaccgtaaccggtaacccgtaaccggtaaacccgaaaacggtaaacttcccggtaacgtttccctttaccggtacccgtaaccttggttaaacccggttcctaaccggttacccgtttacgacccgggttaacccctaacccgggttacccggtaacccgtaaccggg

SEQ ID NO: 147600 - DNA, 788 bp, Homo sapiens
  misc_feature: GYAE6OF02HNEJY.21.86.H09.1.454.CMB.1.raw
  modified_base (149)..(149): a, c, t, g, unknown or other
  misc_feature (149)..(149): n is a, c, g, or t
  modified_base (297)..(297): a, c, t, g, unknown or other
  misc_feature (297)..(297): n is a, c, g, or t
tcagtcgtcgctcgcacgaccggtgctcgatttagtgctatagactttgggtttgggggccagggtgtggtttcctgtttaaatgtagcctcccccgctgcagaattgcagagcctgctgaattctggctgaccagggcagtcaccagngctccagacaagtgtctgtcctccttcctcgacttcgttcctgcccgtagtcgggccctccagtgggtctccgtgtcgactaaatcacgcgtgcagcgacgtccggtacaggtactggtacgaacgccctcggaccaccgccccttcncctactaccgaccgtcggcctaaccgacgttccccgggtaacggggtaagtaacgtttactttaccgtttactacccgaaccgtttaacgttaacggtttacgttagggtaaacgttttacgggaaccttacggaaccggttcccgtaaccgggtttaccccggtaacgggtaacggtaacccgggttacccgtttaagggacggggttaacgggtacgggtaaacggggtaaacggtaacctttcgtttaaccgaaccggttacggtaccttaagggttacggtggtttaacttacgttagtacgtttacggtcgtacggttagtttcgttcgttacggtagtaacggtaaggttacgaagttacgaacgtactacgaaccgttaccgaaccgtaacccgaagtaacctacgtaccttacgttaccgtccgtacgtacttacgttccgacgttacgttcgtcgtaacccgtcccgtaccgtaacgtccgg

SEQ ID NO: 147601 - DNA, 756 bp, Homo sapiens
  misc_feature: GYAE6OF02G8ODP.21.86.H09.1.454.CMB.1.raw
  modified_base (177)..(177): a, c, t, g, unknown or other
  misc_feature (177)..(177): n is a, c, g, or t
  modified_base (264)..(264): a, c, t, g, unknown or other
  misc_feature (264)..(264): n is a, c, g, or t
  modified_base (394)..(394): a, c, t, g, unknown or other
  misc_feature (394)..(394): n is a, c, g, or t
tcagtcgtcgctcgcacgaccggtgctcgatttagtgctatagacttgggtttgggggccagggtgtggtttcctgtttaaatgtagcctcccccgctgcagaattgcagacgcctgctgaattctggctgaccagggcagtcaccgagacgctccagacaatgtctgtctcctctnatctcctgccctagtcggcctccagtgggtctcctgtcgactaaatcagctgcagcgtacggtcccggtacaggtacgtggacgacncccgtacgctacgtccctcgtcactccacgtcgcaactcgtcgacgggatagttacttcttacgccaacgtacttagttaaccgttggtaattcggatttaccgacggttacccaccggtttaccccggnggaacggttccggttaccggtttaggtcggttcggaaccgggttagggtaaccgtacgttcgtttaccgtacggaaccggttacgaaggttggtttacgtttacgttccgttaagttaacgttcgtcgttaaccggttgtttacggttcggtagtagtaaagggtacgtaacgggttaacggttaccggaacctacgttaccgtaaaccgtaacgggtaaccccggaaacccgtaaacgggtaaactacgttaccccgttacgtttacccccgtcggttaacgttccgtttaaccgccgttaacgtttaccgggttaccgtaccggtaccccggtttaacccgtacgtaacccgggttccgg

SEQ ID NO: 147602 - DNA, 951 bp, Homo sapiens
  misc_feature: GYAE6OF02GOLLZ.21.86.H09.1.454.CMB.1.raw
tcagtcgtcgctcgcacgaccggtgctcgatttagtgctatagacttgggtttgggggccagggtgtggtttcctgtttaaatgtagcctccccgctgcagaattgcagagcctgctgaattctggctgaccagggcagtcaccagacgcctacagacaatgtctcgtccttccttcctactacttccttcctcgcccgtacgtccggtccctccgtaggttggggtcgtccgtcgtacgaactaaacgtacagtctagaccgacgaccgtacggtcccggtaccggacgggtacggttacgggtaccggtaaccggtcccgtaccggtaccgaacccggtaccccttacccttacccgtaccctacccgtaaccgtcggacccgtaaccgttaacccgggttccgggggtacccgggggtaagttaacgtttaaccttttaaccgttttaacctaaccccgtaaaccgttaaaccggtttaacgtttaacggtttaacggttaaacggttacgggttaacgtaccggggtaccggacccggttacccgggttaccccggtacgggtaacgggttacccggttaccggtttacgggtaacgggggttcgggtacgggtaaacgggggtaaaccgttaacgtttaccggtttaaccggaacggttaaccggtacgttaaagggtcggtttaacgtttaccgttacggtttaaggtaactttacggacgggttacgttacggttacggtttcgttagggtaacggtaaacggttaacgtagggtaacggtactaaccgtacgttaacccgtaaaccggacccgtaaaccggtaacccggaaagttaaccgtaaccgtttacgttacccgtttacccgtccggttaaggtttactaaggtttccaaccggttactttacggaccggttcccaacccggttccggtaaccgtacg

SEQ ID NO: 147603 - DNA, 821 bp, Homo sapiens
  misc_feature: GYAE6OF02GCMLU.21.86.H09.1.454.CMB.1.raw
  modified_base (176)..(176): a, c, t, g, unknown or other
  misc_feature (176)..(176): n is a, c, g, or t
  modified_base (237)..(237): a, c, t, g, unknown or other
  misc_feature (237)..(237): n is a, c, g, or t
tcagtcgtcgctcgcacgaccggtgctcgatttagtgctatagacttgggtttgggggccagggtgtggtttcctgtttaaatgtagccctccccgctgcagaattcgcagagcctgctgaattctgctcgacagggcagtcacgagagctccgagacagtgtctgtcctccttcncactccttacgtcgaccgtgtcggcctaccgaggttcgggtctccgtcgtacacgttaacncgacgtcctgaccgagtaccgtaaccgggttccggtaaccgtaacggtaagttcgggtaacgtaccggtaccctcggaccgtaaccggtaccccttccggtaccccgtacctaaccgtcccgttaggtacccaaccttaaccggtttcccggtaccgggtacgttaacgttaacgttcccgtttaaacgttaccaacccggtttacgtttacggtttaaacggttaacggtaacggttttacggaacgttaccggaaccggtacttacccgggtcccgaacggttaccgtaccggggtcttaacggtacggtggaaccggttaggaaaccgtacgttcgttaacgtccggtaacgtaccgtaggtccgtggtttattaccgtagttacgtacgtacggtacgttaacgtcgtacggttgttaacggtagtttaaccggtacgttaacgtcgtaaccgtcgtacgtaccgtaaccgtaaaccgcccgttaaagacgttactacccggttacttaccgtccgtacgttaccgtagttacctaacggcgttaccgtccgtacccggttaccgtcgccgttaacccgg

SEQ ID NO: 147604 - DNA, 869 bp, Homo sapiens
  misc_feature: GYAE6OF02JXMYT.21.86.H09.1.454.CMB.1.raw
tcagtcgtcgctcgcacgaccggtgctcgatttagtgctatagacttgggtttgggggccagggtgtggtttcctgtttaaatgtagcctcccccgctgcagaattgcagagcctgctgaattctggctgaccgagggcagtcacagagctccagacatgtctgttcctccttcctactattccgttccgtcgcccggttagtccgggccctcccgtaggttgggggttcttccgtggttaccgactaaaacgttcgacgcgtacgtcacgtacctacggttccggttaccgaagtaccggttaggttaccgaaccggtccctacgcctaaccgacccctttaccgtaccgtaccttaccaccggtgtacccggactacggttcccgggtacgggtaaacgtattaacgtttacttccaaccgtaacccgtaattacgtttcgtaaggtttaacgtggtaaccgtacgacggttacccgtacccgggttacccgacggtaagggttaacccggttccggttagggtacgggttaccggggtacgggtaaacgggtaacgtaccttacgtttaccgttaaccggtacgggtacccgtaagtacggtttacgtacgttacgttagttaacgttacgtacgtgttaacggtttcgttacgttacgggtaaggtaacgtaaggtaacggttaacggtacgtaacgttacgtaacctaaccgtaaccgtaccggtaaacccgtaaacgtaaccgtaaccgttaccgttacccggtttaacgttccggttaccgttaaccgttaccttacggtaacccttacgttaccggttaccggttacccggtaacccggttacccggccggttaaacccgg

SEQ ID NO: 147605 - DNA, 835 bp, Homo sapiens
  misc_feature: GYAE6OF02GP5RL.21.86.H09.1.454.CMB.1.raw
  modified_base (125)..(125): a, c, t, g, unknown or other
  misc_feature (125)..(125): n is a, c, g, or t
  modified_base (145)..(145): a, c, t, g, unknown or other
  misc_feature (145)..(145): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
tcagtcgtcgctcgcacgaccggtgctcgatttagtgctatagacttgggtttgggggccagggtgtggtttcctgtttaaatgtagcctcccccgctgcagaattgcagagcctgctgaattcnggctgacaggcagtcacagngctcagacatgtctcgtctccttctcatccttcctcgcccgtagtcggccctaccgtaggtgggtctcgtgtcaactaatacncgtcncgcagctacggtcccggaccgaggtacgtggacgaccgtcccgtcgactaacctccttccgtaccgtacctaccgaccgtcggaactaccgtacggtccgggtacgggtaagttacgttacgttaccctttacaccgtaccgttataacgtttacgtagtaacgtgactggacgtccgttaccgtccggtagtacggacggttcgtggtagtcggaacggagtaccggactaacgttcgtacgtacgtacggtacgtacggttacgttaaccgttcgttaacggttagttacgtacgttacggttacggttacggttacgttaacgggttaagggtaaacggggtaaaccgttaacgggttaacggttaaaccgggtaaccgtttaaccgttaacccgtaacccgttaaacccggtaaaccccggaaaacccgttaaaccggttaaccggttacccgttaacccgtttaacccgtttaacccggtttaacccgtaccggttaacggtttaaccggtttaacccgttcccgtttaacccgtaccggttttaacccggaacccgggttttaaccccggtacccgggtaaccccggtaacccggg

SEQ ID NO: 147606 - DNA, 529 bp, Homo sapiens
  misc_feature: GYAE6OF01D8R33.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaggccaggccctgtgctggtcatctacgaggacagcagacgacccgtccggatccctgagagattctctggctccagttcaggtacaagtcggccacgttgactgtcgagtcgggccaggtggaggatgaagcgtgactactactgttactacaacagacgagtagtgttatcgacgttgggtgttcggcggtagggacaaggcgtcgaccgtccgtgggtcacggccgaaggcctccgccccgtgtccactcgtcgttccccc

SEQ ID NO: 147607 - DNA, 507 bp, Homo sapiens
  misc_feature: GYAE6OF01BUWMK.26.67.G01.1.454.CMB.1.raw
tcagagactatactcacgaccggtgctcgatttagagtatacatattgggtttggggtgggctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacacgccactctgaccatcagcgggcccagccaacggatgagggagactactattgtcaggcgtgggagaatactattgtagtgttggcggaggacaggctgaccgtctaggtcagcccaggctcgcccctcggtcactctcgtcccgccctcc

SEQ ID NO: 147608 - DNA, 541 bp, Homo sapiens
  misc_feature: GYAE6OF01AJDWF.26.67.G01.1.454.CMB.1.raw
  modified_base (238)..(238): a, c, t, g, unknown or other
  misc_feature (238)..(238): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
tcagagactatactcacgaccggtgctcgatttagagtatacatattgggtttggggggctcaggaggcagagctctgggaatctcaccatggcctggaccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggccctgtgctggtcatctacgaggacagcagacgaccctcgggatcccngagagattcnctggcctccgagttcagggacaagtggccacttgactgtcaggtggggcccaggtggaggagtgaagctgactactactgttactcaacagacagtagtgttatctacgtgggtgttcggcggagggaccgaagcgtcgaccggtccgtgggtccaggacccgacggccgtcgccccccgtcggtcccaccttccgtccgttccctacccccg

SEQ ID NO: 147609 - DNA, 516 bp, Homo sapiens
  misc_feature: GYAE6OF01BUC4M.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagacgaccctcgggatccctgagagattctctggctccgagttcagggacaatggccacttgactgtcagtgggcccaggtggaggatgaagctgactactactgttactcaacagacagtagtggttatcgacgtgggtgttcgggcggagggaccaaggctgaccgtcgtgggtcagcccaaggctcgcccctcggtcactctgtccccg

SEQ ID NO: 147610 - DNA, 514 bp, Homo sapiens
  misc_feature: GYAE6OF01A5VQV.26.67.G01.1.454.CMB.1.raw
  modified_base (239)..(239): a, c, t, g, unknown or other
  misc_feature (239)..(239): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggccctgtgctggtcatctacgaggacagcagacgaccctccgggatccctgagagattctctggctccagttcagggacaatggccacttgactgtcagtggggcccaggtggaggatgaagctgactactactgttactcaacagacagtagtggttaatcacgtgggtgttcggcggagggaccaagctgaccgtctgggtcagcccaaggctcgccccctcggtcactctcgtccctaccc

SEQ ID NO: 147611 - DNA, 206 bp, Homo sapiens
  misc_feature: GYAE6OF01BB72R.26.67.G01.1.454.CMB.1.raw
  modified_base (202)..(206): a, c, t, g, unknown or other
  misc_feature (202)..(206): n is a, c, g, or t
tcagagactatactcacgaccggtgctcgatttagagtatacatattgggtttgggctcaactctcttgtccaccaagggcccatcggtcttccccctggcaccctcctccaagagcacctctgggggcacagcggccctgggctgcctggtcaaggactacttccagtatagtctctgagcgggctggcaaggcgcatagnnnnn

SEQ ID NO: 147612 - DNA, 540 bp, Homo sapiens
  misc_feature: GYAE6OF01BQALM.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagacgaccctcgggatccctgagagattctctggctccagttcagggacaagtcggccaccttgactgtcaggtgggcccagggtggaggatgaagctagactactactgttactcaacagacagtagtgttatcgagtgggtgttcggcggaggaccgagcgtgaccgtccgtgggtcacggcccgaacggtcctccggtcccccgtcggtacccaccttccgtccgttcccccg

SEQ ID NO: 147613 - DNA, 539 bp, Homo sapiens
  misc_feature: GYAE6OF01BAMDZ.26.67.G01.1.454.CMB.1.raw
  modified_base (239)..(239): a, c, t, g, unknown or other
  misc_feature (239)..(239): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggccctgtgctggtcatctacgaggacagcagacgaccctccgggatccctgagagattctctggctccagttcagggacaatggccaccttgactgtcaggtcggggcccagggtggaggatggaagcgtgactactactgttactcaacagacagtagtggttatcgacgtgggtgttcggcggagggaccaagcgtcgaccgtccgtcgggtcaggcccgaggcctcggcccccgtcggtccaccgtccgttcgttccccgtccccg

SEQ ID NO: 147614 - DNA, 748 bp, Homo sapiens
  misc_feature: GYAE6OF01DI2XW.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggaccaaacggccaggatcacctgctccggagatgcattgaccaaaaaatntgcttattggtaccagcagaagtcaggccaggccctgtgctggtcatctacgaggacagcagaccgaccctccgggactcccgtgaagagtattctcgtcggccttccgagtttcgaagggacaagtcggaccctaccgttgacgttggtacgtagggtcgggggccccgaggggtggggaagggtagtaggaaacggtcgtaggtaaccttacgttaacgtttacggtttaaacctaccgaaaccgtaacggaacgtaacgggtttaaggtttacgggttttaacttaccggtacgggtttacggggggtttacggttccgggggtaaccgggggtaacgggggaacccggtaaacggtccggttaccgggtaaccccggttcccggttacggggggttacccaaccgggtacccccggtaaacggggtccccgttaccccgggtacccccccggttaccgggttacccctacccgtttcccgttcccgggtttaaccccccccc

SEQ ID NO: 147615 - DNA, 529 bp, Homo sapiens
  misc_feature: GYAE6OF01EH4UA.26.67.G01.1.454.CMB.1.raw
  modified_base (242)..(242): a, c, t, g, unknown or other
  misc_feature (242)..(242): n is a, c, g, or t
  modified_base (418)..(418): a, c, t, g, unknown or other
  misc_feature (418)..(418): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctccgggatccctgagagattctctggctccagttcagggacaagtcggccacttgactgtcaggtcgggcccagggtggaggatgaagctgactactactgttacncaacagacagtagtggttatcgacgtgggttgttcggcgggagggaccaagctggaccgtcgtgggtcacggcccgaaggcctcgtccccctcggtccactcgtcgtcccc

SEQ ID NO: 147616 - DNA, 559 bp, Homo sapiens
  misc_feature: GYAE6OF01ETJOE.26.67.G01.1.454.CMB.1.raw
  modified_base (243)..(243): a, c, t, g, unknown or other
  misc_feature (243)..(243): n is a, c, g, or t
  modified_base (539)..(539): a, c, t, g, unknown or other
  misc_feature (539)..(539): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagacgaccctccgggatccctgagagattctcgtggctccagttcgagggacaagtggcccacttgactgtcgaggtcggggccctagggtggaggtagtaggaagctgactactactgttactacaacagacagtagtggttatcgacgttgggtgttcgggcgggacggaccgaagcgtacgaccgtccgtgggtacacggcccgaaggcctaccggtcccccgtcggtaccnccttccgtccgttacccccg

SEQ ID NO: 147617 - DNA, 518 bp, Homo sapiens
  misc_feature: GYAE6OF01CT5WI.26.67.G01.1.454.CMB.1.raw
  modified_base (334)..(334): a, c, t, g, unknown or other
  misc_feature (334)..(334): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaaattgcttattggtaccagcagaagtcaggccaggcccctgtgctggtcatctacgaggacagcagacgaccctcgggatccctgagagattcnctggctccagttcaggacaatggccacttgactgtcagtgggccaggtggaggatgaagctgactactactgttactcaacagacagtagtagttatcacgtgggtgttcggcggaggaccgaagcgtgaccgtccgtgggtcacggcccaaggcctcgccccctcggtcactctcgtcccccg

SEQ ID NO: 147618 - DNA, 528 bp, Homo sapiens
  misc_feature: GYAE6OF01CNU4T.26.67.G01.1.454.CMB.1.raw
  modified_base (411)..(411): a, c, t, g, unknown or other
  misc_feature (411)..(411): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaattgcttattggtaccagcagaagtcaggccaggcccctgtgctggtcatctacgaggacagcagacgaccctcgggatccctgagagattctctggctccagttccagggacaatggccacttgactgtcagtggggccaggtggaggatgaagctgactactactgttacncaacagacagtagtggttatcacgtgggtgttcggcggagggacaagcgtgaccgtcgtcgggtcaggcccgaaggcctcggcccccgtggtaccactccgtcgttccccgtccccg

SEQ ID NO: 147619 - DNA, 531 bp, Homo sapiens
  misc_feature: GYAE6OF01DJ01R.26.67.G01.1.454.CMB.1.raw
  modified_base (242)..(242): a, c, t, g, unknown or other
  misc_feature (242)..(242): n is a, c, g, or t
  modified_base (516)..(516): a, c, t, g, unknown or other
  misc_feature (516)..(516): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctccgggatcccgtgagagattctctggctccgagttcgaggacaagtcggacctaccgttgactgtcgaggtcggggcccagggtggaggatgaagctagactactactgttactcaacagacagtagtgttaatcgagtgggtgttcggacggaggaccagcgtcgaccgtcgtggtcacggcccaggcctcgccccgtgtcnctcgtcgttcccccg

SEQ ID NO: 147620 - DNA, 599 bp, Homo sapiens
  misc_feature: GYAE6OF01C9W0R.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttggggggctcaggaggcagagctctgggaatctcaccatggcctggaccctctcctgctccccctcctcactttctgcacagtctctgaggcctcctatgagctgacacagccaccctcggtgtcagtgtccccaggacaaacggccaggatcacctgctccggagatgactaattgaaccaaaaaatntgtactttattggtaaccagacaagaacgtcacggccacggccctgtgcctggtcatcgtacgaggacacgcacgaccgacccggtcggactcccgtagagtagtattccgtcgtacggcctacgtagttacgaagggaactagtcggaccctaccgtgacgtgtacgagggtccggggacccgtagggtgggaaggtagtaggaacgtcgtagacttaacctacgttacgttactacaacgagactagtagtggttactcgtaggtgggtacgttcgggacggacggactagcgtacggccgtcgtggcacgacccgagccgtcccgccccgtgtaccacttctccgtccctacccg

SEQ ID NO: 147621 - DNA, 535 bp, Homo sapiens
  misc_feature: GYAE6OF01DD4BR.26.67.G01.1.454.CMB.1.raw
  modified_base (244)..(244): a, c, t, g, unknown or other
  misc_feature (244)..(244): n is a, c, g, or t
  modified_base (335)..(335): a, c, t, g, unknown or other
  misc_feature (335)..(335): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtcccccaggacaaaacggccaggatcacctgctccggagatgcattgaccaaaaaaatntgcttatggtaccagcagaagtcaggccaggcccctgtgctggtcatctacgaggacagcagacgaccctcgggactccctgagagattcnctggctccagttcagggacaatcgggccaaccttgactgtcagtgggcccagggtggaggatagaagctagactactactgttactcaacagacagtagtgttatcagtgggtgttcggcggaggacaacgcgtgaccgtccgtcgggtcacggcccgaacggcctacgtcccccgtcgtccgacctcgtcgttcccccg

SEQ ID NO: 147622 - DNA, 637 bp, Homo sapiens
  misc_feature: GYAE6OF01CQ7W1.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaaatntgactttattggtaccagcaagaagtcaggccacggccctgtcgctggtcatcgtacgaggacagacacgaccgacccgtccgggactcccgtgaagagtattcctcgtcggctacgtagttacgagggactaagtcggacctacgttgactgtcgaggtcggggccagggtggaggataggaagtcgtagtaacctacgtaactagttacacgaacagtacgtaggtagttggttaatacgtacgttggggtcggttcgggacgggtaacggaccgaacggcgtcggtacccggttcgtacggggtccgtaacgggacccgaacgggtcccgttacccgggtccccccgttcgggttaccctacccgttcccgttcccgttcccccgtacccccg

SEQ ID NO: 147623 - DNA, 795 bp, Homo sapiens
  misc_feature: GYAE6OF01C555M.26.67.G01.1.454.CMB.1.raw
  modified_base (240)..(240): a, c, t, g, unknown or other
  misc_feature (240)..(240): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgacttattggtaccagcaagaagtcaggccaggccctgtgctggtcatcgtacgaggcagcagtacgacccgtcgggactcccgtgagagtacttctcgtggcctccgtaggttcgaagggactaaagtcggaccctaaccgtttggaaccgttggttacccgaagggttcggggggacccccgtaagggggttacgggaacggggttaagttacgggaaacggtaccgttacggtaaacccgttttaaacccgtaaccgtttaacggttttaaacccgttaaccgaaaccgtaacggtaacctaagggtttaagggtttagggttttaaactaccgttacgggtttaggggtttccgggttacggggccggggtaacggggaacccgtaaacgggtcccggttaccgggtaccccggttaccggtacgggggttacccgaaccgggtaacccccggtaaacggggtcccgttaccccgggtacccccccggtttacccggggtacccttacccggttaccccgttttccccgggttccccccttaacccccgg

SEQ ID NO: 147624 - DNA, 527 bp, Homo sapiens
  misc_feature: GYAE6OF01D5ANQ.26.67.G01.1.454.CMB.1.raw
  modified_base (246)..(246): a, c, t, g, unknown or other
  misc_feature (246)..(246): n is a, c, g, or t
  modified_base (331)..(331): a, c, t, g, unknown or other
  misc_feature (331)..(331): n is a, c, g, or t
  modified_base (512)..(512): a, c, t, g, unknown or other
  misc_feature (512)..(512): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctccggagatgcattagaaccaaaaaaaatntgcttattggtaccagcagaagtcaggccaggcccctgtgctggtcatctacgaggacagcagacgaccctcgggatccctgagngattctctggctccagttcagggacaagtcggccaccgttgacttgtcgaggtcggggcccagggtggaggatgaagctgactactactgtactcaacagacagtagtgttatcgacgtgggtgttcggcggaggaccagcgtcgaccgtcgtggtcacgcccgaggcctccgcccctgcncctcgtcgtcccccg

SEQ ID NO: 147625 - DNA, 586 bp, Homo sapiens
  misc_feature: GYAE6OF01ETK1Z.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacatagccaccctcggtgtcagtgtccccaggacaaacggccaggatcacctgctccggagatgcattgaccaaaaaaaatntgcttattggtaccagcagaagtcaggccaggcccctgtgctgctcatctacgaggacagcacgacgacccgtccgggatccccgtagacgagactttcgtactgggcctaccaggtttcgaacgggacaagtcgggcccctacttggactgtacgacggtcggggcccagggtgggacggtagtagaagcgtagacttacgtacttagtaccttacaacgaagactaggtaagttaggttatcgtacgtagggttgtacggacgggacggaccgaggctacggaccgtccgtgggtcacgacccgaaggcctaccggcccctacggtcaccgtcgttcccgg

SEQ ID NO: 147626 - DNA, 522 bp, Homo sapiens
  misc_feature: GYAE6OF01CYZR7.26.67.G01.1.454.CMB.1.raw
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
  modified_base (477)..(477): a, c, t, g, unknown or other
  misc_feature (477)..(477): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctccggagatgcattgaccaaaaaaatntgcttattggtaccagcagaagtcaggccaggcccctgtgctggtcatctacgagacagcagacgaccctccgggatccctgagagattctctggctccagttcagggacaagtcggccacttgactgtcagtgggcccaggtggaggatgaagctagactactactgttacncaacagacagtagtggttatcgagtgggtgttcggcggaggaccgtaagctgaccgtccgngggtcaggcccaaggctacgcccctcggtccactctcgtcccccg

SEQ ID NO: 147627 - DNA, 533 bp, Homo sapiens
  misc_feature: GYAE6OF01AD94T.26.67.G01.1.454.CMB.1.raw
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtgtcccccaggacaaacggccaggatcacctgctccggagatgcattgaaccaaaaaaatntgcttattggtaccagcagaagtcaggccaggcccctgtgctggtcatctacgngacagcagaccgaccctcgggactccccgtgagagattcctcgtggctccagttcagggacaagtcggcctacgttgactgtcgaggtcgggccagggtggaggntagagcgtgactactatgttacncaacngacagtagtgttatcgtagtgggtgtcggagggacgacagctcgccgtcgtgggtccacggcccgaggcctccgccccgtcgtccacgtcgtcgttccccg

SEQ ID NO: 147628 - DNA, 624 bp, Homo sapiens
  misc_feature: GYAE6OF01EGPAR.26.67.G01.1.454.CMB.1.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccgganatgcattgaaccaaaaaatntgcttattggtaccagcagaagtcaggccaggccctgtgctggtcatcgtacgaggacagcacgaccgacccgtcgggactcccgtgacgagtacttctcgtggcctccgtagttcgaggactaagtcggccctacgttgactgtacgagggtcggggccctagggtcgggaggagtgaagcgtagacttacgtacgttcgttacctacgaacagtactaggttagtaggttactacgtacgttggggttaggttccgggacgggacgggtaccgaaggtccgtacggtacccggttccggtcgggtaccgacggtaccccggaacggtcccgtcccggtcccccgttcgggtaccctacgttcccgtcccgttaccccccg

SEQ ID NO: 147629 - DNA, 639 bp, Homo sapiens
  misc_feature: GYAE6OF01AN14V.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtcgctggtcatctacgaggacagcacgaccgacccgtccgggactcccgtagagagacttcctcgtcggtcctcgacgttacgacggacagtcggaccctacgttcgactcggtcgacgggtcgggccgagggtgggaggagtaggacgtcgtacgtacttacgtacttacgttaacctaccgaacgtacgaacgtagttaaggttacgttaacttcgtacggttcgggttacggttcgggacgggtacgggaaccgaggtccgtaccggtacccggttccggtcgggtaccaccggcccggaacggtcccgtcccggtcccccgttcggtacctcccgttccgttcccgttacccccg

SEQ ID NO: 147630 - DNA, 660 bp, Homo sapiens
  misc_feature: GYAE6OF01D96H3.26.67.G01.1.454.CMB.1.raw
  modified_base (237)..(237): a, c, t, g, unknown or other
  misc_feature (237)..(237): n is a, c, g, or t
tcagagactatactcacgaccggtgctcgatttagagtatacatattgggtttgggggggctcaggaggcagagctctgggaatctcaccatggcctggaccctctcctgctcccctcctcactttctgcacagtctctgaggcctcctatgagctgacacagccaccctcggtgtcagtcgtcccaggacaacggcaggatcactgctcggagatgctattacgaaccaaaaaatntagtactttagttcggtaccagacaagaagtcgaggccacggccctgtgcgtggtacagtacgtacgacggacacgcacggaccgacccgtcgggactcccgtgaagagtacttcgtcgtcggcctacgaggttcgaagggactaacgtcggaccctacgttgacgtcgtacgacgggtcgggaccgagggtggaggagtacgagcgtagacttaacttacgttacgttacacgaaacgaggtacgtaaggttgttacgttatacggtaggttggggttacggtaccgggacgggtaacgggtaccgtaacggcgttaccggtacccggttcggtaccgggtaccaccgggacccgtaaggtccccgtacccgtcccccggttcggttacctacccgtttccgttcccgtccccttaccccgg

SEQ ID NO: 147631 - DNA, 670 bp, Homo sapiens
  misc_feature: GYAE6OF01DBYKI.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattcgaaccaaaaaaatntagtacttagttacggtaaccagacaggaagtcgaggccgacggcccctgtgctggtcatctacgagacagcacgccgaccgtccgggactcccgtagacgagtattctcgtggcctcgagttcgagggactaagtcggaccctacgttcgactcgttacgagggtccggggacccgagggtagggaggtattaggaacgtctacgtaacttaactacgttacgtttaccacaaccgagtaacgaacggttagttaggttaactcggtaacggttggggtttacgtacggggtacgggaacgggtaaccgaagtccggtacggtcccggttaccggtcgggtacccaacggtccccggaacgggtcccgttacccgggttacccccgtcggtacccgtacccgtttcccgttcccggttccccccg

SEQ ID NO: 147632 - DNA, 571 bp, Homo sapiens
  misc_feature: GYAE6OF01C17Z7.26.67.G01.1.454.CMB.1.raw
  modified_base (242)..(242): a, c, t, g, unknown or other
  misc_feature (242)..(242): n is a, c, g, or t
  modified_base (299)..(299): a, c, t, g, unknown or other
  misc_feature (299)..(299): n is a, c, g, or t
  modified_base (516)..(516): a, c, t, g, unknown or other
  misc_feature (516)..(516): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattgaaccaaaaaatntgcttataggtaccagacagaagtcaggccacggcccctgtcgctggtcatctacgnggacagcagaccgacccgtcgggactcccgtgagagtacttcgtctaggctaccgagttcgaagggacaagtcggcctacgttgactggacgaggtcgggacccagggtcggaggatgaagcgtgaactactactagttacacaacagacagtagtagttatcgtacgttgggtagttcgggagggaggaccaggtcgtacggaccgtcgcgggtanacggcccgaggtccctccggtccccctcggtaccacgttccgtccgttacccccg

SEQ ID NO: 147633 - DNA, 520 bp, Homo sapiens
  misc_feature: GYAE6OF01CG6JN.26.67.G01.1.454.CMB.1.raw
  modified_base (240)..(240): a, c, t, g, unknown or other
  misc_feature (240)..(240): n is a, c, g, or t
  modified_base (399)..(399): a, c, t, g, unknown or other
  misc_feature (399)..(399): n is a, c, g, or t
  modified_base (419)..(419): a, c, t, g, unknown or other
  misc_feature (419)..(419): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctccgggatccctgagagattctctggctcagttcaggacaagtcgccaccgttgactgtcagtggggcccagggtggaggatgaagtcngactactactgttactcaanagaacagtagtgttatcagtgggtgtcggcggaggacagctgccgtcgtggtcagcccagggcctcggccccctcggtccactccgtcgttcccctacccg

SEQ ID NO: 147634 - DNA, 676 bp, Homo sapiens
  misc_feature: GYAE6OF01BEZ1Z.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaggccaggccctgtgctggtcatctacgaggacagcagaccgaccccgtcggacctccgagagagtacttccgtcgcgtcctacgtacgttacgtagtacgaactacggtccggacccttacgttacgtacgttcgtacggtacggggtcccggggaccggtagggggtacgggaacggtagtaacggacgtcgtaaccgtaacttaccgttacggttacgtttactaaccgtaacgacgtaacggtaaggttaggtttacggttacgtaccgtacgggttcgggttacgggttcgggacgggtaacgggaaccgtacgtccgtaccggtcccggtcggttgggaccgcccggacccggtacggtcccgtccccgtccccggttcgtaccttcccgttccggttcccccgg

SEQ ID NO: 147635 - DNA, 556 bp, Homo sapiens
  misc_feature: GYAE6OF01B82M9.26.67.G01.1.454.CMB.1.raw
  modified_base (244)..(244): a, c, t, g, unknown or other
  misc_feature (244)..(244): n is a, c, g, or t
  modified_base (538)..(538): a, c, t, g, unknown or other
  misc_feature (538)..(538): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctccggagatgcattgaccaaaaaaatngcttatggtaccagcagaagtcaggccaggcccctgtgctggtcatctacgagacagcagacgaccctcgggactcccgtgagagattctcgtggtctcctagttcgaagggacaagtggacctaccgttgactgtcaggtcgggcccaggtggaggatgaagctagactactactcgttactacaacacgacagtacgtagttatcgtagtgggttgttcggcgggaggaccaaggcgtacggaccgtccgtgggtaccacggcccgaaggccgtcgcccccgtcggtacccncgttccctcgttaccccc

SEQ ID NO: 147636 - DNA, 828 bp, Homo sapiens
  misc_feature: GYAE6OF01EW1XP.26.67.G01.1.454.CMB.1.raw
  modified_base (128)..(128): a, c, t, g, unknown or other
  misc_feature (128)..(128): n is a, c, g, or t
  modified_base (130)..(130): a, c, t, g, unknown or other
  misc_feature (130)..(130): n is a, c, g, or t
  modified_base (136)..(136): a, c, t, g, unknown or other
  misc_feature (136)..(136): n is a, c, g, or t
  modified_base (813)..(813): a, c, t, g, unknown or other
  misc_feature (813)..(813): n is a, c, g, or t
tcagagactatactcacgaccggtgctcgatttagagtatacatattgggtttggggggctcaggaggcagagctctgggaatctcaccatggcctggacccctctcctgccctccctcctcttcttncncacgtntctgaggcgtcctctagagctcacgacacgccgaccctaccggtcggtctacgtaggttcccgaccggaacgaaaccggaacccggaccggaagtactacctacgtcgtcccggtacggaatgtcgacttacgtaaccgaaaaaacttaaaaatgtacgttactttacggtacgaacgagacgaaagtacgacggaccgaccgacccgtccgttgcgtcggttcgactcgtaccgaagggacacgacgacgaacggaccccgtacccggtacggtaccctacggtaggaacgtacgtttcttccgtcggtcgtccttacggtacggttacggaacggaaactacgggtcccgaacctttacgtacgtacgtcgtacgggtacggggtcccggtacggtaggggttacggaagtacggtaacggacgttacgaacgttaaccgttaacttcgggtttaccttaaccgaaaccgaaaggtaccgtaggttaacgggttaggtttacggttacctacggttacggggttgggtttaccgggtccggggaacgggtaacgaaccgtaccggtcggttacccgggtacccgttcggggttccggaacgtaccccgggtaccggtacgttcccgtaccccccggttcccggtcgttacctacccgtttcccggtttaaccccncccccgtttacccgg

SEQ ID NO: 147637 - DNA, 800 bp, Homo sapiens
  misc_feature: GYAE6OF01DIDT7.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaaacggccaggatcacctgctccggagatgcattgaaccaaaaaaatntgcttattggtaccagacagaagtcaggccaggcccctgtcgctggtcatctacggaggacagcacgaccgaccccgtcgggaactcccgtgaacgagtacttcgtcgtggccttaccgtaggtttcgaaggggacaaagtcgggaccctaccgttggaacttggtacgaggggttcgggggccccgtaaggggttgggaagggtaagttagggaaacggtccgttaacggaacctttaaccgttaacgtttacggtttaacctaccgaaaccgaaggtaacctaagggtttaagggttaacggttttaacgttccggttaaaccgggtttggggggtttacgggttttaccggggaccgggggtaacggggaaacccgtaaaacgggtccggttaccgggtaaacccccgggtttcccgggttaacgggggtacccaaacggggtaaccccccggaaaacggggtccccgtttaccccggggtccccccccgtttaaccggggttaccccttaacccggtttccccggttccccgggttttacccccccccgg

SEQ ID NO: 147638 - DNA, 758 bp, Homo sapiens
  misc_feature: GYAE6OF01DFVZV.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctccggctccccctcctcactttctgcacagtctctgaggcctcctatgagctgacacagccaccctcggtgtcagtcgtccccaggacaaacggccaggatcacctgctccggagatgcattagaaccaaaaaaatntgcttattggtaccagcagaagtcaggccacggccctgtgctggtcatctacgaggacagcacgaccgacccgtcgggatcccgtgagagtacttcgtcgtcggcctccgtaaggttcgaaggggtacaaagtcggaccctaccgtttggaaccttgggtaccgtaaggggttccgggggaccccgtaggggtagggtaagggtacgtagggtaaacggtcgtacggtaaccgttaaccgttacgttacgtttaacttaccgaaaccgaaggtaaccgtaaggttacggtttagggtttaacttaccgtacgggttacggggtttacgggtttaccggggacggggtaacggggtaacccgtaaacggtccgttaccgggtaccccggttccgggtacgggggttacccgaacgggtacccccggaaacgggtcccgttacccgggtccccccccggttaccgggttacccgtacccgtttcccgtttcccgttacccccccgttaacccccg

SEQ ID NO: 147639 - DNA, 645 bp, Homo sapiens
  misc_feature: GYAE6OF01DKV47.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgaggcctcctatgagctgacacagccaccctcggtgtcagtcgtcccaggacaaacggccaggatcacctgctccggagatgctaattagaaaccaaaaaaaatntagcttaattggaccagcagaagtcaggccaggccctgtgctggtcatcacgaggacagcaagaccgacctccgggactcccgtagagagtattctcgtcggctaccgagttccgaagggaacaagtcgacctacttgactgtcgaggtcgggccgagggtcggaggagtagaagtcgtacgacttactactagttaacctacaacgacgtaacgtaggttagttggtttaactcgtaacggttgggtacgggtttcgggaacgggaacgggaacccgaaggtacccgtacgggtacccggttaccggtcggggttacccgaaccggtaccccgaaacgggtcccgtcccggtacccccgtcgggtaccctacccgttccgttcccgttaccccccg

SEQ ID NO: 147640 - DNA, 598 bp, Homo sapiens
  misc_feature: GYAE6OF01BSY2B.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctccggagatgcattgaaccaaaaaaaatntgacttattggtaccagcagaagtcaggccaggcccctgtcgctggtcatctacgaggacagcagaccgaccctccgggactcccgtggagagtattcctcgtggcctccgtaggttcgaggggtaacaaagtccgggaccctaaccgtttggaacttggtacgagggttcggggcccgtaggggtcgggaagggagtaggaaagtcgtagaaccttaacgttacttagttacctacaacagaactagtagttggttaatcgtacgtgggtgttcgggcgggacggacagcgtcgaccgtcgtggcacggccgaaggcctccgccccgtcgtccactccgtccgttcccccg

SEQ ID NO: 147641 - DNA, 519 bp, Homo sapiens
  misc_feature: GYAE6OF01ERJQ1.26.67.G01.1.454.CMB.1.raw
  modified_base (241)..(241): a, c, t, g, unknown or other
  misc_feature (241)..(241): n is a, c, g, or t
  modified_base (326)..(326): a, c, t, g, unknown or other
  misc_feature (326)..(326): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctccggagatgcattgaccaaaaaaatntgcttatggtaccagcagaagtcaggccaggccctgtgctggtcatctacgaggacagcagaccgaccctccgggatccctgagngattctctggctccagttcagggacaatggccaccttgactgtcaggtcggggcccgaggtggaggagtgaagctgactactactgtactcaacagacagtagtgttatcacgtgggtgtcggcggagggacagcgtcgaccgtcgtggtcagcccgaaggctcgccccctcggtcactctcgttccctaccc

SEQ ID NO: 147642 - DNA, 690 bp, Homo sapiens
  misc_feature: GYAE6OF01CQFMQ.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgaggcctcctatgagctgacacagccaccctcggtgtcagtcgtcccaggacaacggcaggatcacctgctccggagatgcattagaaaccaaaaaaatntgactttatacggtaccagacagaagtcaggccacggcccttgtcgtcgtggtacctagtaccgtaacgacggaacacgacgaacggaaccgaccccgtaccgggtactcccccgtaggaacgtacggtactttccgtcgtcgggtaccctaccgtaggttaccgaagggaacctaaggtccggtaccctacgtttagacgttcgtaccggacgggtcggggacccgtagggtacgggtaggagtagaagacgtacgtactaacgtacgttacgttaactacaacgaagtactaggttagtggttaactcggtacggttggggttcggtacgggacggtaacggggaccgtaacggtcgtaccggtaccgggtaccggtgggtacctacggccgtaacggcccgttccgcccccgttacgtccgtaccttccgtcccgtttaccccc

SEQ ID NO: 147643 - DNA, 743 bp, Homo sapiens
  misc_feature: GYAE6OF01D3KAG.26.67.G01.1.454.CMB.1.raw
  modified_base (252)..(252): a, c, t, g, unknown or other
  misc_feature (252)..(252): n is a, c, g, or t
tcagagactatactcacgaccggtgctcgatttagagtatacatattgggtttgggggtgggctcaggaggcagagctctgggaatctcaccatggcctggaccccctctcctgcctccccctcctcactttctgcacagtctctgaggcctcctatgagctgacacagcccaccctcggtgtcagtcgtccccaggacaaacggccaggatcacctgctccggagatgctattacgaaaccaaaaaaattntgtactttagttacggtaaccagacaagaagtcaggccacggcccctgtgctggtcatcgtacggaggacagacagaccgacccgtccgggactcccgtgaacgagtattccgtctcggcttaccgagttcgaagggactaagtcggacctaccttggtacgttcggtacgacgggtccggggacccgtaggggtagggaacgggagttacgggaaggtccgtaggtaaccttaaccgttacgtttaccggtttaacctaaccgaaacgtaacggtaactaagggttaaggttgggtttaaccttacggttacgggttggggtttaccgggtttaccggggacggggtaaccgggaccgtaaagggtcccgtaccggtacccggttcccggttacgggtacccgaaccgggtaccccgtaacgggtcccgttcccgggtaccccccgttcgggttaccctacccgttcccgttcccggtttccccccccgg

SEQ ID NO: 147644 - DNA, 542 bp, Homo sapiens
  misc_feature: GYAE6OF01A306E.26.67.G01.1.454.CMB.1.raw
  modified_base (240)..(240): a, c, t, g, unknown or other
  misc_feature (240)..(240): n is a, c, g, or t
  modified_base (427)..(427): a, c, t, g, unknown or other
  misc_feature (427)..(427): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggccctgtgctggtcatctacgaggacagcagaccgaccctccgggatccctgagagattcctcgtggctccagttccagggacaagtcggaccaccttgactggtcagggtggggcccgaggtggaggagtgaagctaggactacgtactgttacncaacagacagtacgtaggttatcgtacgtgggtgttcggcggagggaccaagtcgtgaccgtccgtaggtcagacccgaggcctcgccccctggccacgtctccgtcccgtcccg

SEQ ID NO: 147645 - DNA, 628 bp, Homo sapiens
  misc_feature: GYAE6OF01AT5XC.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattgaaccaaaaaaatntgcttagttggtaccagcagaagtcaggccaggcccctgtcgctggtcagtctacgaggacagcagaccgacccgtcgggaatccccgtagagagacttcgtcgtcggcctaccgagttacgagggtaacaaggtcggaccctaccgttgactggtcagggtcgggacccagggtcggaggatgaacgcgtagactacgtactagttacctacaacgagtaacgtaaggtagttaggttactcgacggttggggttcggttacgggacgggtacgggtaaccgaaggtccgtacggtacccggttccgtacggggttacaaccggcccgaacgggtccctcccggtcccccgttcggtacctcccgttccgtccggttcccccg

SEQ ID NO: 147646 - DNA, 763 bp, Homo sapiens
  misc_feature: GYAE6OF01B3S8G.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtggactcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcactgctcggagatgcattcgaaccaaaaaaatntagtacttaagttcggtaaccagacaagaagtcaggccacggcccctggtgctggtcatcgtacgaggacaggacacggaccgacccgtccgggactcccgtagacgacgtattcgtcgtggcctccgtacggtttacgaggggtaacctaacgtcgggaccctaccgtttgaaccttcggtacgacggggttcggggacccgtaggggtacgggaacgggtagtaggaacggtcgttacggaaccttacgttaccgtttaacggtttaacctaaccgtaacgtaacggaacgtaaggttaacggttacgggtttaacgtaccggtaacggtttgggggtttcgggttaccggggacggggtaacggggaaccgtacggtaccggttaccgggtaccccggttaccgggtcggggtaccgaacccgggtaccccgtaaaccgggtcccgttaccccggtacccccccggttacgggttaccccttaccggttcccgtttccccgggtttacccccccgg

SEQ ID NO: 147647 - DNA, 752 bp, Homo sapiens
  misc_feature: GYAE6OF01B5NSQ.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctccggagatgcattgaaccaaaaaaatntgcttattcggtacagcagaagtcaggccacggccctgtgctggtcatcacggaggacagcagaccgacccgtaccgggactcccgtaggagacggtactttctaccgtcggtcctccgtacgttcgaacgggtactaagtcggaccctaccgttaggaaccttggtaccgtagggtcgggggacccgtaggggtacgggtaagggacgttaggaaacggtccgttacggaaccttaacttaccgttacgtttaaacctaccgaaacgtaacggtaaccgtaagggtttaacggttacgggttttaactccggtttaacggttcggggggtttacggttaccggggacggggtaaccggggaccgtaaacgggtccgttacggtacccggttccgggtacggggtaacccgtacggaccccggtaacgggccccgttacccggtaccccccccggttacgggttaccccgtaaccgtttccccgttaccccgttaccccccgttacccccg

SEQ ID NO: 147648 - DNA, 724 bp, Homo sapiens
  misc_feature: GYAE6OF01DE6JZ.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcaattacgaaccaaaaaaatntgtactttaattggtaaccagcaagaagtcgaggcccacggcccctggtcgcgtggtacatcgtaacgaggacagcaacggaccgacccgtccgggactcccgtagacgacgtacttcctcgtcggcctccgaagttaccggaaggggtaacctaaacggttccggaccctaacccgtttggaaccgttcggtacggtaacggggtccgggggacccgtaaggggtgggaagggtagtaaggtaacggtacgtaacgtaaccgttaaccgttacgttacgtttaacctacgaaacgtaacgacgtaacggttagtttagggttaacttcggtaacggttggggttcggttacgggacgggaacgggaccgtaacggtcgtaccggtaccgtaccggtacgggtaccacggacccggtaacggcccgtacccggcccccggttcggtacccgttacctccgttcccgttccccgtaccccg

SEQ ID NO: 147649 - DNA, 660 bp, Homo sapiens
  misc_feature: GYAE6OF01C8KB1.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttggggggggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctccggagatgcattagaacctaaaaaaatntgtacttagttcggtaccagcaagaagtcgaggccacggccctgtcgcgtggtcagtcgtacgaggacagcacgaccgacccgtccgggactcccgtagacgagtacttctcgtggcctccgtagttcgaagggaacagtcggaccctacgttgacttggtcgacgggtcggggccgtagggtggaggtagtaggagtcgtagtactacgttacgttacgttacgtacaacgagtaactaggggggggttattaggttacttacgtacggttggggttcggttccgggacgggtacgggaccgaacggccgtacggtacccggtccggtcgggtaccgtacggacccggacgggcccgtcccgtcccccgttccggtacccgtaccgttcccgtcccggttcccccgtcccccg

SEQ ID NO: 147650 - DNA, 765 bp, Homo sapiens
  misc_feature: GYAE6OF01D34WT.26.67.G01.1.454.CMB.1.raw
  modified_base (260)..(260): a, c, t, g, unknown or other
  misc_feature (260)..(260): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccacccgtcggtgtcagtcgtccccgaggacaaaccggccaggactccacctgccgtccggagatgactattacgaaacctaaaaaaatntagtactttaagttcggtaacccagacgaaggtaacgtccgacggacccgacggccccgttggtcggtccgttggttacctaacgttaccggtaacggaacggaaccaggaccgaacggtaccccggtacccccgttaccggggaacctccccggtaggaacggtacgttactttccgtcgtcggtaccttacccgtacggttacggaacgggtaactaacggttccggaccctaaccggtttcgaaccgtttcggtaccggtacggggtaccggggtacccgtaggggttacgggaacggtaagttcggaacgtacgtacggtaaccttaccgttacgttacgttactaacgaacgtagtacgtagtaggttcgttaacgtcgtacggttgggtccgttacgggaacggtaacgaaccgagtccgtacggtacccggttcggtacggaccacggtacccgaggtcccacccgtcccgtacgtcctaccttcgtcccgtaccccg

SEQ ID NO: 147651 - DNA, 544 bp, Homo sapiens
  misc_feature: GYAE6OF01EQHAM.26.67.G01.1.454.CMB.1.raw
  modified_base (239)..(239): a, c, t, g, unknown or other
  misc_feature (239)..(239): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctccggagatgcattgaccaaaaaaatntgcttaatggtaccagcagaagtcaggccaggccctgtgctggtcatctacggaggacagcagaccgacccgtcgggatccctgagagattcnctggcctccgagttcagggacaacgtcggcctaccttgactgtcaggtcggggccgaggtggaggatagagctgactactactgttactacaacaganagtagtggttanctagtgggtggttcggcggagggaccagcgtcgtaccgtcgtgggtcacggacccgaggccgtccgaccccctcggacctacctcttccgtccccgtacccc

SEQ ID NO: 147652 - DNA, 573 bp, Homo sapiens
  misc_feature: GYAE6OF01DNT6Z.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattgaaccaaaaaaatntgcttattggtaccagcagaagtcaggccaggcccctggtgctggtcatctacgaggacagcagaccgccctccgggatccccgtgagagattctcgtggctccgagttcagggacaagtcggccacttgacttgtcgaggtcggggcccagggtggaggagtgaagctagacctactacgtacgttactacaacgagactaggtagttaggttatcgtagttgggtggttcggcgggacgggacaaggctcgaccgtccgtgggtcgacgcccgaaggtcctaccggtccccccgtcggtccctaccgttccgttccggttacccccc

SEQ ID NO: 147653 - DNA, 727 bp, Homo sapiens
  misc_feature: GYAE6OF01B6NKD.26.67.G01.1.454.CMB.1.raw
tcagagactatactcacgaccggtgctcgatttagagtatacatattgggtttgggggggctcaggaagcagcatcggaggtgcctcagccatggcatggatccctctcttcctcggcgtccttgcttactgcacaggatccgtggccttcgatgagctgattcagccaccctcagtgtccgtgtcccaggacagacagccacatcacctgctcggcagacaaattgggagatagaaatgctgcctggtattaccagacggccaggccacgtcccctagtttcggtcatctccaagactaagaacgcgcctcagggactccctgaccgtaattctggcctaccacgttctacgggaactacacggcccacgtcctcgaacccagtccgacggccggggtacccagacccgaacggactacgggaacggggtaacgacgttaaccgttagttcggtacgaacgggtccggtaggggtaacgtaagttaaccgttaagtttaccgggtttaaggtttacgggttttacgggggtaccggggtaaggggtaccccgtaaggggtcccgttacgggtaaccccgggtaccgttaccggggttaccgaaccggggtaccccgtaaacggggtcccgttacccgggtaccccccccgttacggggttacccgtaaaccgtttccccggttacccgtttacccccccgttaaccccgttccctttaaccccggg

SEQ ID NO: 147654 - DNA, 809 bp, Homo sapiens
  misc_feature: GYAE6OF01AWCPG.26.67.G01.1.454.CMB.1.raw
  modified_base (250)..(250): a, c, t, g, unknown or other
  misc_feature (250)..(250): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggatcacctgctccggagatgctattacgaacctaaaaaaatntagtactttaagttacggtaaccagacaagaagtcgacggccacggccctgtcgctggtacagtctacggacggacaggcacgaccggacccgtccgggactcccgtaggagagtacttctacgtcggacctaccgtaggttaccgaggggtaactaacggtccggaccctaccgtttacgaccgttcggtaccggtacggggttccgggggtaccccggtaggggttacggggaagggtaacgtacggaacggtaccgtacggtaaaccgttaaccgttaccgtttacggttaacccttaacgaaaccgtaacggtaacgttaagggtttaacggttacggtttaacgttaccggttaaccgggtttcggggttacgggtttaccggggacggggtaacggggacccgtaacgggtccggttaaccgggtacccggtttacccgggtacggggttacccggtaacccgggtaccccggaacgggttccccggtaccccggttccccccggttacccgggttacccttacccgttcccggttccccggttaaccccccg

SEQ ID NO: 147655 - DNA, 660 bp, Homo sapiens
  misc_feature: GYAE6OF01CX10R.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgcctccggagatgcattgaaccaaaaaaatntgtcttatggtaccagacagaagtcaggccaggcccctgtgctggtcatctacggagacagcaggaccgacccgtccgggactcccgtagacgagtattccgtcgtcggcctaccgagtttacgagggaacaagtcgggaccctacgttgactcggtcagggtccggggaccctaggggtggaagggataggaacgtcgttaacgacgttaacgttacgttcgttaactcgaacgtacgaactacggttaggttaggttactacggtacgttggggttacgttacggggtacgggacgggtaaccaacggtccgtacggtacccgttccggtcggggtaccaccggtcccgaacgggtccctcccgggtacccccgttcggtacctacccgttcccgttccgttacccccccg

SEQ ID NO: 147656 - DNA, 733 bp, Homo sapiens
  misc_feature: GYAE6OF01EK98H.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaggccaggccctgtgctggtcatcgtacgaggacagcagaccgacccgtccgggactcccgtgacgagtattcctcgtggcctccgtaagtttccgaagggaaccaaagtcggaaccctaccgtttgaccttggtaccgtacgggttcggggaccccgtaggggtacgggagggtaagttaggaaacggccgttaggtaacccttaacgttaaccgttacggtttaaacccgtaaccgaaaccgtaacggtaaccgtaagggtttaggttacgggtttaactaccggtaacggttgggggttacgggtttaccggggaccggggtaacggggaaccgtaacggtccgttacggtaacccgggttccggtcggggttaccgaccggtacccccggaaacgggtcccgttaccccgggtccccccgttccgggtaccctaaccgtttcccgttcccggtttacccccccg

SEQ ID NO: 147657 - DNA, 606 bp, Homo sapiens
  misc_feature: GYAE6OF01CZU6J.26.67.G01.1.454.CMB.1.raw
  modified_base (247)..(247): a, c, t, g, unknown or other
  misc_feature (247)..(247): n is a, c, g, or t
  modified_base (567)..(567): a, c, t, g, unknown or other
  misc_feature (567)..(567): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaaacggccaggatcacctgctccggagatgcattgaaccaaaaaatntgcttatgtacagcagagtcaggccaggcccctgtgctggtcagtctacgaggacagcagacgccctcgggactcccgtgacgagtacttctctggcctcgacgttcaggacaagtcggcctacgttgactgtacgtacgggtcgggcccgagggttgggacggtagtacggaagtctacgaccttacgtacttagttaacctacaacgagaccgtaggttaagttgttaactccgtagttgggtaggttcgggacggacgggtacccaaggtccgtacgtacccggtccggtcggtcgaccggtcccgaacggttcccncgtcccccgtggtccctacgtcccgttccgttacccccg

SEQ ID NO: 147658 - DNA, 624 bp, Homo sapiens
  misc_feature: GYAE6OF01D5AXB.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattagaaccaaaaaaaatntgtacttattggtaccagcagaagtcaggccaggcccctgtgctggtcatctacgaggacagcagaccgaccctcgggatcccgtgagagtattcctcgtcggctccgagttcagggaacaagtcggaccctacgttgacttgtcgtaggtcggggcccgagggtcggaggagtaggaagctagtactactacgttagtacctacaacagactaggtagtgttactcgtacggttgggttcggttcgggacgggacgggtaaccgaaggtccgtaccggtacccggtccggttggggtaccaccggaccccgaacgggtcccgtacccggtccccccggttacggtacccttacccgttcccgttcccggttccccccg

SEQ ID NO: 147659 - DNA, 727 bp, Homo sapiens
  misc_feature: GYAE6OF01B2LJB.26.67.G01.1.454.CMB.1.raw
  modified_base (251)..(251): a, c, t, g, unknown or other
  misc_feature (251)..(251): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatcacctgctccggagatgctattacgaaaccaaaaaaaatntagcttagttaggtaccagcaagaagtcaggccaggcccctgtgctggtcatcgtacggggacagcacggaccgacccgtccgggactcccgtagacgtacgtactttcgtcgtcggtcctcctacggttaccgaaggggaacaagtcggccctaaccgtttgacgttcggtacgagggttccgggggacccgtaggggtagggaacgggtagtaggaaacgtcgtacggtaacctttaacgtaccgttagtttaaccaccgaaacgaaggtaaccgtaaggttaacgttacgggtttactaccggttacggttggggttcgggttaccggggtacggggaacgggtacccgaaggtccgtaccgggtacccggtccggttcgggtacgtaccggacccccggtaacgggcccgttccccggacccccggttccggtacctaccccgtttccgttccccgttacccccgtaccccg

SEQ ID NO: 147660 - DNA, 594 bp, Homo sapiens
  misc_feature: GYAE6OF01A8G3T.26.67.G01.1.454.CMB.1.raw
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaattgcttattggtaccagcaagaagtcaggccaggccctgtgctggtcatctacgaggacagcagacgaccctcgggatccctgacgagtattcctcgtcggctcctagttcgaacgggacaagtcggccctacttgactgtcgagggtcggggcccgagggtcggaggagtgaagcgtagactactacgtgttacacaacgagacgtagtagtggttatcgtacgtgggttacggttcgggacgggacgggaccgagccgtacggtacccgttcggtcgggtaccacggacccgtaacgggtccctacccggcccccgttcggtaccctaccgttccgtccgttccccgtcccccg

SEQ ID NO: 147661 - DNA, 679 bp, Homo sapiens
  misc_feature: GYAE6OF01BTZEL.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccagatcacctgctccggagatgcattagaaccaaaaaaaatntagcttagttggtaccagacagaagtcaggccacggcccctgtcgctggtcatctacgaggacagcaacgaccgacccgtccgggactcccgtagagacgtacttctcgtcggtcctccgtagttacgaacgggaactaacgtcggaccctaccgttgtaccgtggtacgacgggtcggggcccgaggggtgggaggtagtaggaaacgtcgtacgtaactacttacgttacgttaacctacgaacgtaacgaacgtaggttaaggttacggtttaatacgtacgggtttcgggttacgggttcgggacgggtaacgggaccgtaacggtccgtacggaccccggttcggtacgggtaccgaccggacccgaacggtcccgttacccgcccccggttacggtaccctaccgttcccgttcccggttccccccgg

SEQ ID NO: 147662 - DNA, 648 bp, Homo sapiens
  misc_feature: GYAE6OF01CHFQ0.26.67.G01.1.454.CMB.1.raw
  modified_base (242)..(242): a, c, t, g, unknown or other
  misc_feature (242)..(242): n is a, c, g, or t
  modified_base (495)..(495): a, c, t, g, unknown or other
  misc_feature (495)..(495): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaatntgcttattggtaccagcaagaagtcaggccaggccctgtgctggcatctacgagacagcagaccgacccgtcgggactcccgtagagagtattctcgtggcctccgagttcgaagggacaaagtcggaccctaaccgttgacgttgtacgtagggtccgggggaccctaggggtcgggaaggtagtaggaagtcgtaggtacctacgttacgttgttaacctacaacgaacgtagtaagttagtcggtttaancgtacggttgggttgttcgggacggtagggaaccaggtccgtcggtaacccggttccggtcgggtaccaaccggtaccccggaaacgggtccccgttacccgggtccccccgtacgggttacccaccccgttccgttcccgttaacccccccg

SEQ ID NO: 147663 - DNA, 581 bp, Homo sapiens
  misc_feature: GYAE6OF01CIXIO.26.67.G01.1.454.CMB.1.raw
  modified_base (245)..(245): a, c, t, g, unknown or other
  misc_feature (245)..(245): n is a, c, g, or t
  modified_base (428)..(428): a, c, t, g, unknown or other
  misc_feature (428)..(428): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattgaaccaaaaaaaatntgcttatggtaccagcagaagtcaggccaggccctgtgctggtcatctacgaggacagcagaccgccctcgggatcccgtgagagtattcctctggctcccgtagttcgaggacaagtcggccctacgttgactgtcaggtcgggccagggtggaggataggaagctgactactactgttacncaacgagacaggtagtggttaatcgtacgttgggtaggttccgggcgggtaacgggaccgaaggtccgtacgtacccggtcggtcgggtacacggtaccccgaggcccgtccggtcccccgttcggacctacttcccgtccggtttacccccc

SEQ ID NO: 147664 - DNA, 587 bp, Homo sapiens
  misc_feature: GYAE6OF01BDD6H.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattagaaccaaaaaaaatntgcttaattggtaccagcagaagtcaggccaggcccctgtgctggtcatctacgaggacagcacgaccgacccgtccgggactcccgtgagagacttctctggctccagttcgagggacaagtcggcctaccgttgactgtcgaggtcggggccctagggtggaggatggaagcgtagtactactacgtgttactacgaacagactagtagtggttatcgtacgtgggttcgttcgggcggtagggaccgaaggtccgtacggacccggttccgtcgggtacacggtccccgacggtcccgtccgtcccccgtcgggtaccaccgttccgtccgttaccccc

SEQ ID NO: 147665 - DNA, 730 bp, Homo sapiens
  misc_feature: GYAE6OF01BU07Q.26.67.G01.1.454.CMB.1.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
tcagagactatactcacgaccggtgctcgatttagagtatacatattgggtttggggtggctcaggaggcagagctctggaatctcgaccatggcctcggacccctctcctcgcctccccctcctccactttctcgcacacgttcctcctgacggcctcctatgacgctgacacacgcccaccgtcggtntcagtcgcccagacaacgcagntcactnctcgagatgctatacgaaaccaaaaaatgtacgtacttagttacggtaaccagacgtaagaacgtccgacggaccgaccggtccccgtgcgtcgtaggtacacgttaccaacggaggaccgacgacgaaccgacccggtaccgtaccggactacccgtaggaactagtacttcgtcgtcgtaccttacgtagttaccggaacggtaaccgtaacgtccgttacccgtaaacgtttgtaccgttacggtacggtaccggggtaccggacccgggtaagggttagggaacgttaagaggaaccgtcgtaacgtaccttaacgttacgttacttacgacaacgagtaacggttagtacggtacgttactacgtaggggtttacgtacgggtacgggacgggtaccaacggtgtaccggtaccgtccggtacgttcggacccaacggtaccgacggtcccttccccgggttccccgtaacggttccctaccggttcccgttcccccggttaccccg

SEQ ID NO: 147666 - DNA, 720 bp, Homo sapiens
  misc_feature: GYAE6OF01DZC13.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgcctcccccctcctcactttctgcacagtctctgaggcctcctatgagctgacacagccaccctcggtgtcagtgtccccaggacaaacggcaggatcacctgctccggagatgcattacgaaccaaaaaaatntagtcttagttggtaaccagacaaggaagtcacggccacggcccctgtgctggtcagtcgtacggaaggacagaccacggaccgacccgtccgggaactcccgtgaagacgtacttcctacgtcggtcctaccgtagttccgagggaactaaggtccggaccctaaccgtttcgaacgttggtaccgtacggggtcgggggacccgtaggggtacgggagggtagtgggtacgtacgtacgtaccgttacgttacgttacggtttaaccacgaaactagtacgtaggtaagttggttaataccgtagggttggggttcggttacgggaccgggtaacgggaaccgtaaggtccgtaaccgggtcccgttacgggtccgggtaccaccgggtaccccggaaacgggtcccgttacccccgggtcccccggttacggtaccccgttacccgttcctttccccggttaacccccccg

SEQ ID NO: 147667 - DNA, 762 bp, Homo sapiens
  misc_feature: GYAE6OF01BSAGA.26.67.G01.1.454.CMB.1.raw
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
  modified_base (441)..(441): a, c, t, g, unknown or other
  misc_feature (441)..(441): n is a, c, g, or t
  modified_base (609)..(609): a, c, t, g, unknown or other
  misc_feature (609)..(609): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccacccgttcggtgtcaggttccgtacccccgaggaaccaaacggccaaggactccaccgtgcgtccgganagtgactattacgaaaccaaaaagtntagtacttaggttaggaacctagacaaggtacgtcgaacggccaccgggtccccttggtcgtccgttgggtacctagtttaccgaacggagacacgaccgacggacccgacccgtccgggtactccccgtagacgtactacgttccgtcgtcggtacttccgtacgttaccggnggtaacctagtacccggtacctacgttcggtacgttcggacgtacggggtaccggggccgtaaggggttcggggacggttaacgtcggaaacggtccttaacgggtacttacccgttagttaccgttaacaacgtagtaacgtacgtaacgggttttagcgtttaacncggttaacggggtggtttacccggtacgggaaccggggaacgtaccgtacgggtccttaccggaccggttccgggtagacccgtaccggtaccgtacggtccctccccgggtacccgtactcccgttacccttccgttccccgtaaccccccg

SEQ ID NO: 147668 - DNA, 660 bp, Homo sapiens
  misc_feature: GYAE6OF01CGKDF.26.67.G01.1.454.CMB.1.raw
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctccggagatgcattgaaccaaaaaatntagcttatggtaccagcaagagtcaggccaggccctgngctggtcatcgtacgagacagcacgaccgcccgtacgggactcccgagagagtacttccgcgtcggcctccgaagttaccgagggtaacaacgtcggaccctaaccgttggactcgtacgtaggtccggggacccgaggggtcggaaggagtagaaacgtctagtactactagttagtacctacgaacagacgtagttagtacggttactaccgtaggttcgggttacggttcggggacggtacgggaaccctaaggtccgttacgggaacccgttccgggtacgggttaccgaaccgggtaaccccgaacgggtcccgtaccccggtccccccgttacggtacccttacccgttccgttcccggttaaccccccccg

SEQ ID NO: 147669 - DNA, 720 bp, Homo sapiens
  misc_feature: GYAE6OF01CKWWF.26.67.G01.1.454.CMB.1.raw
  modified_base (249)..(249): a, c, t, g, unknown or other
  misc_feature (249)..(249): n is a, c, g, or t
tcagagactatactcacgaccggtgctcgatttagagtatacatattgggtttgggggtgggctcaggaggcagagctctgggaatctcaccatggcctggaccccctctcctgcctccccctcctcactttctgcacagtctctgaggcctcctatgagctgacacagcccaccctcggtgtcagtcgtccccaggacaaaacggccaggatcacctgctccggagatgcattagaaccaaaaaaatntagactttagttaggtaccagacaagaacgtacgaggcccaacggcccctgtcgcgtggtcacgtactacgagacagacagaccgacccgtccgggaactcccgtagaacgtagtactttccgtcgtcgggtcctacccgtaggttcgaaacggggactaaagtcggaccctaccgtttagactggtacgagggtccgggacccgagggtacgggaggagtacggaacgtacgtagtaaccttacgtaacgtttagttaacctacgaaacgaacggtaaccgtaaggttaggttacggtttaactcgtaaccggttggggttacggttcggggacgggtacgggaaccgtaacggtcgtaccggtaaccggttccggtacgggtacccgacggtaccccggacggtacccggtaccccgtccccccggttacggttcccctaaccgttccccgttcccggttacccccccg

SEQ ID NO: 147670 - DNA, 605 bp, Homo sapiens
  misc_feature: GYAE6OF01CWS5M.26.67.G01.1.454.CMB.1.raw
  modified_base (223)..(223): a, c, t, g, unknown or other
  misc_feature (223)..(223): n is a, c, g, or t
  modified_base (454)..(454): a, c, t, g, unknown or other
  misc_feature (454)..(454): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtcccccaggacaaacggccaggatcacctgctccgganatgcattgaccaaaaaattgcttatggtaccagcagaagtcaggccaggcccctgtgctggtcatctacggagacagcagaccgacccctcgggactcccctgagagtattcctcgtcgcctctagttcagggtacaagtcggcctaacgttgacttgcgtacgggtcggggacccaggggtacgggagggacgtaggaacgtcgtagaccttaactacgttgtttaaccncgaaacagaccgtaagttacggtaggtttaatcgtaacgtgggttcggtcgggacggaggtaccgaagcgtacggtaccgtcgtcgggtccgaacggtcccgaacggtcctcccgtcccccgttcgaccctaccttccgtcgttacccccc

SEQ ID NO: 147671 - DNA, 683 bp, Homo sapiens
  misc_feature: GYAE6OF01DHW2K.26.67.G01.1.454.CMB.1.raw
  modified_base (184)..(184): a, c, t, g, unknown or other
  misc_feature (184)..(184): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
  modified_base (390)..(390): a, c, t, g, unknown or other
  misc_feature (390)..(390): n is a, c, g, or t
  modified_base (448)..(448): a, c, t, g, unknown or other
  misc_feature (448)..(448): n is a, c, g, or t
tcagagactatactcacgaccggtgctcgatttagagtatacatattggggtttgggggtgggctcaggaggcagagctctgggaatctcaccatggcctggacccctctcctgcctccccctcctctactttctgcacagtctctgaggcctcctatgagctgacacacgcccacccgtggtntcagtcgtcccgaggaaccaaacggccaaggatcacctgcgtcggantgactattagaaaacctaaaaaatntacgtacttagttacggaccagacgaagaagtacaggaccgaccggtcccgttagcggaccgttaggtactaacgttacaacgggaacgacagaccgaacgacccggtacccgtccgggtaactcccgagaagngtacttcgtaccgtggacctacgtagtacggaacggtacaacgtcggaccctacgtanacgtacgtacggtacgggtcgggaccgagggtagggaagtaagtacggaacgttacgtaagtaccttaacgtacgtagttaaccacgtaaacacggaagttacgttaggttcgtaactcgggtacggttagggtacgtcggggaacggtacggactaagtccgacgtaccgtcggacgacaccgccgtagggccctacccgtcccgttaggaccctcggttccgtccgttacccc

SEQ ID NO: 147672 - DNA, 883 bp, Homo sapiens
  misc_feature: GYAE6OF01A3ZLX.26.67.G01.1.454.CMB.1.raw
tcagagactatactcacgaccggtgctcgatttagagtatacatattgggtttgggggtgggctcaggaggcagagctctgggaatctcaccatggcctggaccccctctcctgcctccccctcctcactttctgcacagtctctgacggcctcctatgacgccgtacgacacgccaccctccggtgtcacgtcgtccccacggaacgaaaccggaccgtaggacgtaccaccgtacgccgtccggacggatcgcgacttacgtaaccgaaaaaaactaagtgtacgtttaacgtttaggtaccgaacgacgaaggtaaaacggttaccgaacggaccgaaccggtccccgttcggttggtccgttcggtaccgtaacgttaccgtaacggaacgggaacgacgaccgaacgaacccggaccccgtccgggacgtccctacggagaacgttacttccgtcgtacggtcctaccgtacgtacgtacgggaacgtaacgtacggtccctacccgttacgtaacggttcgttaccggtacgggttacccggggggacccgtaacggggtaggggtaacgggtaacgtacgggttaaacgtccgtaacggttaaacccgttaaccgtttacgtttaacgggttttaccaacccgtaaaccgaaggtaaccgttaaggtttaagttttaagggtttacctacggtaccgggtttagggggttcggtaccgggtcgggaaccggttaaccgacgtaccgttccgggttaaccccgtccgggttaggtccgaacggacccccggtagggtaccccgtcccccgggttacccccccgttccgggttaactcccccggtttacccgttcccgggtttcccccctacccccgg

SEQ ID NO: 147673 - DNA, 740 bp, Homo sapiens
  misc_feature: GYAE6OF01CHO16.26.67.G01.1.454.CMB.1.raw
  modified_base (243)..(243): a, c, t, g, unknown or other
  misc_feature (243)..(243): n is a, c, g, or t
  modified_base (332)..(332): a, c, t, g, unknown or other
  misc_feature (332)..(332): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattagaaccaaaaaaatntgacttagttggtaccagcaagaagtcaaggccaggccctgtgctggtcatctacgaggacagcagaccgacccgtccgggactcccgngagagtattcgtcgtcggtcctccgtaggttacgaaggggtaacctaacgttcggacccctaccgtttaggaaccgtttggtacggtacggggtccggggggaccccgtaaggggtcgggaacggggtagtacgggaaaggtccgttaacgtaaccgttaccttacgttacgttaacctaccgaaaccgtaggaccgtaaggttaggttaggttacgttacgtaacggtttcgggggttacggttccggggtacgggtaaccgggtaaccgtaacggttcccgttaacccggttccggttacggggtaccgaccgggtaccccgaagggttccccgtcccgggtaccccccgttcgggtacccctaccggttcccgttacccggttccccccggtcccctttacccgg

SEQ ID NO: 147674 - DNA, 719 bp, Homo sapiens
  misc_feature: GYAE6OF01EES23.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgcctccggagatgcattagaaccaaaaaatntgtcttagttggtaccagacagaagtcgacggccacggcccctgtgctggtcatcgtacggaggacagcacggaccgacccgtcgggactcccgtgagagtattctcgtggcctcacggttacgagggtacaacgtcggaccctacgttcgactcggtacgacgggtccgggggcccgtaaggggtcggggaaggtaggtaggaagtcgttaggtaaccttacgttaccgttacgtttaacctacgaaacgaaggtaaaggttaggttacggtttaactacggtaacggttcgggggttacggtttaccggggacgggtacgggtaacccgaaggtccgtaccgggtacccggttccggtcggggtacccgaccgggtacccggtaaaccgggtcccgtaccccggggtaccccccgttccgggttaccctaccccggtttcccgttccccgggttccccccgttacccccg

SEQ ID NO: 147675 - DNA, 601 bp, Homo sapiens
  misc_feature: GYAE6OF01DRSTX.26.67.G01.1.454.CMB.1.raw
  modified_base (240)..(240): a, c, t, g, unknown or other
  misc_feature (240)..(240): n is a, c, g, or t
  modified_base (327)..(327): a, c, t, g, unknown or other
  misc_feature (327)..(327): n is a, c, g, or t
  modified_base (416)..(416): a, c, t, g, unknown or other
  misc_feature (416)..(416): n is a, c, g, or t
  modified_base (449)..(449): a, c, t, g, unknown or other
  misc_feature (449)..(449): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgacttattggtaccagcagaagtcaggccaggccctgtgctggtcatcgtacgaggacagcacgaccgaccctccgggatccccgngagagtattctcgtcggctccagttcgagggacaagtcggaccctaccttgacttgtcgagggttcggggacccgtagggtggaagggntaggagcgtagacctacttactgttactcgaanagacgagtaggtagttatcgacgttggggttcgttcgggacgggacggaccgaagccgtacggacccgttcggtcggggtaccacggacccgaacggcccgtcccggacccccgttcggtcctaccttccgttcccgttccccgtacccccg

SEQ ID NO: 147676 - DNA, 753 bp, Homo sapiens
  misc_feature: GYAE6OF01CBPQG.26.67.G01.1.454.CMB.1.raw
tcagagactatactcacgaccggtgctcgatttagagtatacatattgggtttgggggtgggctcagggaggcagagctctgggaatctcaccatggcctggacccctctcctcgcctccccctcctctactttctgcacagtctcgtgacggcctctatgagctagacacacgccacccgtggtcgtcgacgtcgtacccgacggaaccgaaaccggccgaaggactcctaccgtcgccgtaccggagtatcgactaacgtaacgaaaacctaaaaaaattgtacgttactttagttacggtaaccagtaacgaaggtaacgtcgaacggcccgacggtcccgtagtcgcgttcggtactacgtacgtacggacgacgacgaccgacgacccggacccgtcggacttccgtagagacgtactcgtacgtcgtcctacgtacgttacggacgaacgtacgtacgtcctacgtgaccgtgtacggtacgggtcgggaccgtaggggtggaagtacgtagaacgtcgttaagtaaccttacgttacgttacgttaaccaacgtaacgtacggtaagtagtttacgggttaagtttaccgttacgggttacgggttcggggttacgggtaccgggaacgggtacgggaaacctacgggtaccggtccgtaccgggttcggtcggaccccggtacggacccgtacggtccctacccggttcccgtacgtaccctttaccgttccgtcccggtacccc

SEQ ID NO: 147677 - DNA, 588 bp, Homo sapiens
  misc_feature: GYAE6OF01B8E6A.26.67.G01.1.454.CMB.1.raw
  modified_base (248)..(248): a, c, t, g, unknown or other
  misc_feature (248)..(248): n is a, c, g, or t
  modified_base (570)..(570): a, c, t, g, unknown or other
  misc_feature (570)..(570): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctccggagatgcattacgaaccaaaaaaatntgtcttagttcggtacagcaagaagtcacggccacggcccctgtgcgtggtcatcgtacggagacagcacgaccgacccgtcgggactcccgtagagagtacttcctcgtcggcctaccgaggttccgaagggtacaacgtcggaccctaccttggacttcggtcgacgggtcggggcccagggtggaggagtggaagcgtagtactactacttgtactacaacgagacgtagtagtggttactcgacgttgggttgtcgggacggacggacgagcgtcggaccgtcgtcggtacgacgccgacggctccgccccgtacgcnccgttcgtccggtccccg

SEQ ID NO: 147678 - DNA, 793 bp, Homo sapiens
  misc_feature: GYAE6OF01EY54P.26.67.G01.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccgganatgcattagaaccaaaaaaatntagacttattggtaccagacaagaagtcacggccacggcccctggtcgcgtcggtcatcgtacggaggacagacacgaccgacccgtaccgggactcccgtagacgtacgtacttccgtacgtcggtcctaccgtaggttaccgaaggggtaaacctaacgttcgggtacccctaaccggtttacggaaccgtttacgggttaccggacggggttaccgggggtaccccggtaagggggttacggggaacgggtaagttaacgggaaacgggtccgttacggtaaacccgtttaaccgtttaacgtttacgtttaaccgtaaccgtaaacgtaacggtaaccgtaaggtttaacggttagggtttaactacggtaggttacgggggtttcgggttacggggaacggggtaacggggaacccgtaagggtccgtaccgggtacccggttaccggtcgggttaccgaaccgggtacccgtaacgggtcccgttaccccggtcccccggttacgggtacccttacccgttcccgttcccggttaccccccg

SEQ ID NO: 147679 - DNA, 734 bp, Homo sapiens
  misc_feature: GYAE6OF01BTN08.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattagaaccaaaaaaatntagtactttagttcggtaaccagacaaggaaacgtcgaacggccacggtcccctagtcgcgttcggtcattaccgtaacggacggacaggccgaacggacccggaccccgtccgggacttccccgtaggaacgagttacgttcctccgtacggccttaccgtaggttaccgaacggggtaactaacggtcggaccctaccgttgaccgttggtaccgtagggtccggggacccgtaggggttacggaagggagtaggaacgtcgtacggtaaccttacgttacgttacgttaccaacgtaaccgtaagtaacgtaggtttacgttaggttaacgtacggtacggttggggttcggttacgggacgggaacggaccgtaacggtccgtacggtcccggtacgtcggggtaccaccggacccggtacggtcccgtcccggtacccccgttcggttaccctaccgtttcccgttcccgttcccccggtaccccg

SEQ ID NO: 147680 - DNA, 748 bp, Homo sapiens
  misc_feature: GYAE6OF01B79DD.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctctatgagctgacacacgccacccgtggtgtcagtcgtaccccgaggaaccaaacggccaggactacacctgcctacggagatgactaattacgaaaacctaaaaaaatgtagtacttagttacggaaccagacagaagtcgacggaccacggtccctgtcgctggtactacgttacacggagacacgacgaacggtacccgacccgtaccgggactcccgtaggaacgtagtactttctcgtacggaccgttactaaggttaccgaacgggtaacgtaacgttccggaacccttaacgttcggtaacctcggttaaccggacggggtccggggacccggttaaggggtagggtaacggaagttaggaacggtacgtaacggtacgttaaccgttaaccgttacgttaaccgtaaacgaacgaacgtacggtaagttacggttacgttacgtacggtaacggttgggtacgggttcggaacggggacgtaacccggagtaccgacggttcccggaggtacccggtacgaccggtcccggaacggtcctaccccgggtccccgttacgacccgtaccttccggttcccgttacccccgg

SEQ ID NO: 147681 - DNA, 567 bp, Homo sapiens
  misc_feature: GYAE6OF01BASZF.26.67.G01.1.454.CMB.1.raw
  modified_base (243)..(243): a, c, t, g, unknown or other
  misc_feature (243)..(243): n is a, c, g, or t
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
  modified_base (423)..(423): a, c, t, g, unknown or other
  misc_feature (423)..(423): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaaacggccaggatcacctgctccggagatgcattgaccaaaaaaatntgcttattggtaccagcagaagtcaggccaggcccctgtgctggtcatctacgngacagcagacgaccctccgggatcccgtgagagattcnctggctccgagttcagggacaagtggccacttgactgtcaggtcgggcccagggtggaggagtgaagctagactactacgttgttacncaacagacagttagtgttatcgacgttgggtgttcggcggagggaccaaggcgtacggaccgtccgtgggtccacggtccccgaacggtccctacccggtccccccgttacggtaccctaccgttccgttccggtttccccccg

SEQ ID NO: 147682 - DNA, 782 bp, Homo sapiens
  misc_feature: GYAE6OF01DTH20.26.67.G01.1.454.CMB.1.raw
  modified_base (260)..(260): a, c, t, g, unknown or other
  misc_feature (260)..(260): n is a, c, g, or t
  modified_base (340)..(340): a, c, t, g, unknown or other
  misc_feature (340)..(340): n is a, c, g, or t
tcagagactatactcacgaccggtgctcgatttagagtatacatattgggtttgggggtgggctcaggaggtagagctctgggaatctcaccatggcctggacccctctcctgcctcccctcctcactttctgcacagtctctgaggcctcctatgagctgacacacgccaccctcggtgtcagtcgtaccccaggaaccaaaccggccgaggactccacctgccgtccggagatgctagttacgaaacctaaaaaaatntcgtactttagttcggtaccagacgaagacgtcgacggtccgacggccctggtcgtcgtggtctacgtcgtacgacgacngacacgaccgacccgtcggactcctaggagacgtacttccgtcgtacggtcctacggtacggttacgaacgggtactaacggtccggtaccctaccgtttgtaaccgttgggtaccggtaacgggggttccggggacccgttaagggggtacgggaacgggtacgttacgggaaaccggttcgttaaccgggtaacttaacgtttaaccgttaacgtttaaccgtaacgaaacgtacggtaacgttaacggttacggtttaacggtttaccgtacgttaacggggttcggggtttaccgggttaccggggaacggggtaacggaccggtaacgtcggttaccgtacccggtcggttacggtaccgaccgggtaccggtaacggcccgtacccggtcccgtccggtccgtaaccgtttcccggtacccgttcccggtaccccg

SEQ ID NO: 147683 - DNA, 837 bp, Homo sapiens
  misc_feature: GYAE6OF01ENSJF.26.67.G01.1.454.CMB.1.raw
tcagagactatactcacgaccggtgctcgatttagagtatacatattgggtttggggggggctcaggaggcagagctctgggaatctcaccatggcctggaccctctcctgctccccctcctcactttctgcacagtctctggacggcctcctatgagctgacacagcccaccctcggtgtcagtcgtcccaggacaaaccggccaggactcacctgcctccggagatgctattacgaaccaaaaaaattgtgtactttaagttacgttaaccagacaagaagtccgaggcccacggccctggtcgcgtggtcacgtctacggaggacacgcgacgaccgtaccgttcggactcccgtgacgtagtactttccgtcgtacggtccttaccggtagtttaccgggaagggtaacctaaagtccgggtacccttaaccgtttaggtaaccccgttggtaccgggtacggggtacccgggggaccgggtaaggggtagggaacgggtacggtaaggacgtttaccgaccggttaaacttaccggtttacgtttaacgtttaccgaaaccgtaacgtaacggtacggttaaggttacgggttaacgttacggttacgttacgggtttcgggggttaaccggggtccggggttaacgggaacgggttaacccgtaacggttccggtacccggggttacccgttacgggttacccgggtacccgtaacccgggaccccgttacggggccccccgtttacccccgggtacccccgggtttaccccggtacggtttacccccggtttacccccgttttccccggtcccccccgttttacccccgg

SEQ ID NO: 147684 - DNA, 895 bp, Homo sapiens
  misc_feature: GYAE6OF01D903V.26.67.G01.1.454.CMB.1.raw
tcagagactatactcacgaccggtgctcgatttagagtatacatattggggtttggggggtgggctcaggaggcagagctctgggaatctcaccatggcctggacccctctcctgcctccccctcctcactttctgcacagtctctgaggcctctatgagctgacacacgccctacccgtcggtgtcagttcgtaccccgaggaaccaaaccggccgaggactccaccgtgccgtaccgggagtatgctaagttacgaaaccaaaaaatgtacgtactttagttacggtacagacgaagtaacgtcgacggccgacggtcccgtggtcgtcgttcggtacaacgttccggtaacgggaacggaccgaggaccgaacggtacccggaaccccggtccgggtaacttaccccggaggtaacgtacgtacgttccgttacgtcggtacctaccggtacggttacggaacggtaacctaacggtacgtacccgttaaccgttaggaccgttacggttacgggtaccgggggttaccggggacccggttagggtacgggggaacggtagtacggtaacggtccgtaacgtaacccgttacgttaaccgttacgttaaccgtaacgtaacgtacggtaaacgttagggtttaaccgggtttaggttaaccgttccggtacgggggtttagggggtttaccgggtaccgggggttaaccggggaacggttaaacccggaacggttcccggttaccccgggtaaccgggtttcccggggttacggggtaacccctaaacccggggtacccgggaaaccgggtttccccgtacccccggttacccccggttacggttaacccgttcccccgggtttccccggttaccccgggttaccccccccg

SEQ ID NO: 147685 - DNA, 536 bp, Homo sapiens
  misc_feature: GYAE6OF01CXFD6.26.67.G01.1.454.CMB.1.raw
  modified_base (239)..(239): a, c, t, g, unknown or other
  misc_feature (239)..(239): n is a, c, g, or t
  modified_base (351)..(351): a, c, t, g, unknown or other
  misc_feature (351)..(351): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaaggccaggccctgtgctggtcatctacgaggacagcagacgaccctccgggatccctgagagattctctggctccagttcgaggtanaagtggacccacgttgaacttggtcaggtcggggcccgaggtgggaggagtgaagtcagtactacgttactggttactcaacagacagtagtgtaatctacgtgggtcgtcggacggaggaccgaagctgaccgtcgtggtcacgccgacgctccgcccgtcgtactactctccgtccctacccg

SEQ ID NO: 147686 - DNA, 812 bp, Homo sapiens
  misc_feature: GYAE6OF01CRLHA.26.67.G01.1.454.CMB.1.raw
  modified_base (138)..(138): a, c, t, g, unknown or other
  misc_feature (138)..(138): n is a, c, g, or t
  modified_base (183)..(183): a, c, t, g, unknown or other
  misc_feature (183)..(183): n is a, c, g, or t
tcagagactatactcacgaccggtgctcgatttagagtatacatattgggtttgggggtgggctcaggaggcagagctctgggaatctcaccatggcctggacccctctcctgcctcccctcctctactttctgcacngtctctgacgcctctatgacgctgacacacgccctaccgtcggtntcgacgtccgtaccccgaaggaaccgaaaccggcacggactccgaccgtcgaccgtaccggagtacgtcgacttaacgttaacgaaaaacctaaaaaattcgtacgttacgtttacggttacggaaccagacgaaggtaaccgtacgaccgggtacccgaccggtcccgtaggttccggtacgtacggttacacgttaccggaacggacggaaccgacggaccgaacccggaccggttacccgacgggtacctaccggtaggaacggtacttacgttccgtcgtccggtaccttacgacggttacgaacgtaccgtacgtccgacctacggtacgcgttacggacgggtccgggtacgggtaacggtcgggagtacgggtagtaggtacgtacgtaacgttacgtaacgttcgttaaacgtacgtaacgacgtaacggttaacgtgttacggttacgtaccggttcggtaacgggttccgggtaggggtacccggtaacggggtaccacggtacggtccgtaccggtaccggtacgggtccggaaccgttcccgggaacggtcccggtacccgtccccggttcccggttaccgtacccggtaaccttccccgttaccccgtaacccccg

SEQ ID NO: 147687 - DNA, 801 bp, Homo sapiens
  misc_feature: GYAE6OF01B9XBY.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgaggcctcctatgagctgacacacgccacccgtcggtgtcagtcgtcccaggacaacggcagatcactgctcggagatgctatacgaaccaaaaaatntgtacttagtcggtaccagacaagacgtcacggccacggccctggtcgcgtggtacacgtctacggaggacacgcaacggtaccgtaccccgtacgggacctacccgtggaacgtacgtactttccgtacgtcgggtacctaccgtacggtttacggaacgggaactaacggtccggacccttaaccgttggaaccgttcggtacggaacggggttccgggggacccggtaggggtacgggaagggtacgtaagggtaacgtcgtaacggtaaccttacgttaaccgttacgttaacccgtaacgaaacgtacgtaacgtagggttaacggttagttaaccgtaccggtacgggttggggttacggttaccggggaaccgggtaacgggaacccgtaaggtacccggttaccgggtacccgggttaccgggttaccggggtacccgtaacccgggtaaccccgggtaaccgggtccccggtttacccccggtacccccccgggttccggttaccccttaacccggtttcccccgtttacccgggtttaccccccccccgg

SEQ ID NO: 147688 - DNA, 739 bp, Homo sapiens
  misc_feature: GYAE6OF01B4SBU.26.67.G01.1.454.CMB.1.raw
  modified_base (254)..(254): a, c, t, g, unknown or other
  misc_feature (254)..(254): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgccaccctcggtgtcagtcgtccccaggacaaacggccaggactccacctgcgtccggagatgctattacgaaaccaaaaaaaatntagtacttagttacggtaccagacaagaacgtcacggccgacggccctgtcgcgtggtcagtcgtacggaggacagcgacgaccgacccgtccgggactcccgtagacgtagtacttccgtcgtcggtcctccgtacggttacgaacgggaactaacgtcgggtaccctaaccgttggaccgttcggtacgacggggtaccggggacccgtaggggtagggaacggtagtacggaacgtcgtacgtaccttaacgtacgttacgttaacctaccgaaacgtacgtaacgttaaggttacggttacggtttaactcggttacgggttcgggggttacggttaccggggacgggtaacggaaccgtaacggtccgtacgggtacccggttccggttacgggacccaaccgggtacccgaacgggtcccgtaccccggtacccccgttacggttaccctcccggtttcccgttccccggttccccccg

SEQ ID NO: 147689 - DNA, 689 bp, Homo sapiens
  misc_feature: GYAE6OF01B4IA5.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggagacagagctctgggaatctcaccatggcctggacccctctcctgcctccccctcctcactttctgcacagtctctgaggcctcctatgagctgacacagcccaccctcggtgtcagtcgtccccaggacaaacggccaggatcacctgctccggagatgcattacgaaccaaaaaaatntgctttaagttcggtaccagacaagaagtcaggccacggcccctgtgctggtcatcgtacgagacagcacgaccgacccgtccgggactcccgtagaagagtacttccgtcgtcggcctaccgtagttcgaacgggactaacgtcggaccctacgttgacgttcgtacgagggtcggggacccgtaggggtggaagggagtaggaacgtcgtacgtaacttacgttacgttacgtttaacctaccgaaacgtaacgaacgttaaggttaggttaggttaactaccggtacggttcggggttacggttaccgggacggggtacgggtaaccgaacggtacgtccggtaccggttccggtcgggtaccgaccggtacccggaacgggtcccgtcccggtccccggttaccggtacctcccgttcccgttcccgtttacccccg

SEQ ID NO: 147690 - DNA, 678 bp, Homo sapiens
  misc_feature: GYAE6OF01A0QMB.26.67.G01.1.454.CMB.1.raw
  modified_base (180)..(180): a, c, t, g, unknown or other
  misc_feature (180)..(180): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (656)..(656): a, c, t, g, unknown or other
  misc_feature (656)..(656): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtntcagtcgtcccaggacaaacggccaggatcacctgctccgganatgcattacgaaccaaaaaatntagtcttattggtaccagctaagaacgtcgaggccacggtccctgtcgctggctatctaacggaggacagcaacggaccgtacccgtcggactcccgaggacgacgtacttcgtacgtcgcctcgtagttacgagggtacaacgtcggaccctacgttacgacgttcggtaccgtaggggtcggggtcccgaggggtagggaacgggtaataggtaaacggccgtaggtaaccttaacgttacgttagttaacctaacgaacgaacgtacgtaaggttacgttacggttaactcgtacgggttaggggttcggttccggggacgggtaacgggacctaacgggtcctacgggtacccgtacgtcggggtacaccggtaccgacggtcctccccggtaccccgtcggttacncccttcccggttcgtacccccg

SEQ ID NO: 147691 - DNA, 873 bp, Homo sapiens
  misc_feature: GYAE6OF01C469P.26.67.G01.1.454.CMB.1.raw
  modified_base (129)..(129): a, c, t, g, unknown or other
  misc_feature (129)..(129): n is a, c, g, or t
tcagagactatactcacgaccggtgctcgatttagagtatacatattgggtttgggggggctcaggaggcagagctctgggaatctcaccatggcctggacccctctcctgctcccctcctcactttcngcacagtctctgaggcctcctatgagctgacacagccacccgtcggtgtcagtcgtccccaaggacgaaaccggccaggatcacctgactcggagatgactattacgaaacctaaaaaaaaatgtagtacgtttaatttacgggtaaccaggacaaggaacgtacgaacgggacccaacgggtccccgtaggttcgccgtggtacacgttaccgtaacggaacgggaaccaggaccgtaacggaacccggtaccccgtaccggggtaactcccgtaggaacgtaagtacctttcgtcgtacggtcctacccgtaagttaccgaagggaacctaagtcgaacccgtaccgtttagaccgttaggtaacgtacggggttaccggggacccgtaaggggtacgggtaacggagttaacggaacggttctaacggtaactttaaaccgtaccgtttaacgtttaaccgacctaaacgtaacgtaacggttaacggtttaacgggttacggtttaacttaccgggtaacggtttacgggggttacgttaaccgggggtaccgggtaaaccgggtaacccggtaaacggtcccggttaaacggttaccccggttaccgggttaaccggggtaccctaaacccgggacccggtaaacccgggttcccgtacccccggttacccccgttcccgggtttaaacccgtacccgtttaccccgtttacccccgggttacccccttaaacccccgg

SEQ ID NO: 147692 - DNA, 854 bp, Homo sapiens
  misc_feature: GYAE6OF01AS6Q8.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccacccgtcggtgtcgagtccgtcccccaggaaccaaaccggccaggactcacctgcgtccggagatcgactaattacgaaaacctaaaaaaatgtcgtacttagttacggtaaccagacgaagaacgtcgacgggaccaccggtccctaggtcgtctggtactcgtacgaacggacggacacggaccgaacgacccggtaccccgtccgggtactccccgtaggaacgtacgtacgtttccgtacggtcggtaccttaccggaggtttaccggaacgggtactaaggttcccggaaccctaccgtttagaccgttacggtaccggtacgggggtccgggacccggtaggggtacgggtaaggtacggtaacggaacggtaccgttaccggtaaccttaaccgttaacgtttacgttaaacccgtacgaaaccgtaacgtaacgttaacgggtttaacggttggtttaacgttaccggttacgggtttcggggttacggggtttaaccggggaccggggaaccgggtaacccgtaacggggttccccggttaccggtaaccccgggtttaccggtaccggggtaacccggtacccggacccgggtaacccggtcccccggtaccccgtcccccggttaccggtacccgtttaccccgttcccggtttaccccgttacccccccg

SEQ ID NO: 147693 - DNA, 658 bp, Homo sapiens
  misc_feature: GYAE6OF01EPQW0.26.67.G01.1.454.CMB.1.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctcggagatgcattagaaccaaaaaaatntagtactttattcggtaaccagacaaggaacgtcacggccacggcccttgtagcgtggtacactcgtaacggaggacagcgacgaccgaccccgtcgggactcccgtgagtacgtattctcncggtctcgtagttcgagggacaagtcggcctacgtgactgtacgtaggtcggggaccgtagggtcggaaggtataggtaacgtcgtacgtaacgttaaccttacgttcgttaactcaaacgtagtaacgtaaggttacggttacggttactacggtacggttcggggttcgggttacgggacggtacgggactaacggcgtacggtccggtacgtcgggtaccgacgtacccgaagggtcccgtcccgtacccccgttcggtaccctaccgttccgttccgtcccctaccccg

SEQ ID NO: 147694 - DNA, 672 bp, Homo sapiens
  misc_feature: GYAE6OF01DS6JV.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattggggtttggggggggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcaccgtgctccggagatgctattagaacctaaaaaaatntcgtacttagttcggtaccagtacgaagaaggtcgaacggcccgacggcccctggtcgcgttggtctagtcgtacggacggacagcgacgaccgacccgtccgggactccctagagacgtacttctcgtcgtctccgtagttcgaaggactacgtcgcctaccgtgctgtcgagggtcggggaccgtaggggtacggaggtagtagaagtcgtacgtaaccttacttacgtacgttaccacgaacgtagacgtaagttaggttacgttactcgtacggttggggttcggttacgggacgggtaacggacccgtaaggtccgtacggtacccggttcggtcgggtaccgaccggtacccggacggtcccggtcccgtacccccgttcggaccctacccttcccgttcccgttacccctaccccgg

SEQ ID NO: 147695 - DNA, 832 bp, Homo sapiens
  misc_feature: GYAE6OF01BVGEF.26.67.G01.1.454.CMB.1.raw
tcagagactatactcacgaccggtgctcgatttagagtatacatattggggtttgggggggctcaggaggcagagctctgggaatctcaccatggcctggaccctctcctgcctcccctctcactttctgcacagtctctgacggcctcctatgagctagacacacgcccacccgtcggtcgtcaggtcgtacccgaaggaacgaaaccggccaaggactaccgaccgtcgaccgtaccgggagtactggactaattacgaaacctaaaaaaatcgtagtactttagtacggtaaccaagaccgaaggtaacgtacgaacggaccgtaaccggtccctggtacgcggttcggtactacgttaccgaacggaaggtaaccacgacaacggaccgtacccggtacggactcccggtaggacgtacgtacttcgtaccgtacggtaccttaccgaaggttacgaacgggtaacaacgtccggtaccctacggtacgtacgttacggtacggtacgggtacggggtacccgaaggggtacggtaagggtacgtaaggtaacgtccgttaacgaacccgtttaacgtacctttacggttaaaccgtaaccgaaaccggtaaggtaacgttaacgggttaaccggtttaggttaaccgtacggttacggggttacgggggttacgggttaacgggaccggggtaaccggtaactacggtaccggtacccggtacccgtaccggttacggggaacctaccgggacccggtaacggtcccctaacccggtcccccgttcggaccttaacccgttccgttaccccgttaccccgtaacccg

SEQ ID NO: 147696 - DNA, 713 bp, Homo sapiens
  misc_feature: GYAE6OF01BCJ5F.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggatccctgacgagattctcgtcggctccaggtttcaagggacaagtcgggaccctaccgtttcgaacttcggtcgtaacgggtcggggcccgagggttcgggaaggtacgtaggaaggtcgttacgtaaccgtttaaccgtaacgttaggtttaaccttaccgaaaccgtacggtaacgtaaggttaacggtttacgggtttaactcgtaacggtttcgggggttcgtttacggggacggggtaccgggtaacccgaaacgggtccgttacggacccggttacccgggtcggggttacccgaccgggtacccccggaaacgggtccccgttacccgggtccccccccggttacgggttacccgtacccgttcccgtttcccggtttaaccccccccg

SEQ ID NO: 147697 - DNA, 788 bp, Homo sapiens
  misc_feature: GYAE6OF01ECER9.26.67.G01.1.454.CMB.1.raw
tcagagactatactcacgaccggtgctcgatttagagtatacatattgggggttggggtgggcgtcaggaggcgacgagcgtctgggaagtacctcaccatggcctcggacccctcctcctcgcctccccctccctctacttctgcacagtctctgaggcctcctatgagctgacacagcctacccgtcggtgtcgagtcgtccccgaggaccaaacggccaggactcacctgctccggagatgactattacgaaacctaaaaaaatgtagtactttagttacggtaaccaagcagaagtccacggccacggtccccttgtacgtcgtcggtctacttaccgtaacggacgggaaccgtaggaccgacggacccgtacccggtaccgggtacttccccggtaggtacggtaagtacttccgtaccgtcgggtcccttaccgtacggttacgaacgggtaaccgtaacgtccggtaccccgtaccggtttacggaccgtttacggtaccggtaacggggttccgggggaccccgtagggttacggggagttaacggtggtaacggtcgttacgggtaacttaccgttacgtttacgttaaccgtacctaacggtacggtaacgtacggttaagttacggttaacgtcggtaaccgggttgggtttaccgggtacgggtacggtaacggaccgtaacggtcgtaccggttccgttacggtcgggtacacggtcccgtaacggccgttcccgtaccccgttcggtacccttccgttccgtccgtacccccg

SEQ ID NO: 147698 - DNA, 906 bp, Homo sapiens
  misc_feature: GYAE6OF01CRXCG.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattggggtttgggggtgggctcaggaggcagagctctgggaatctcaccatggcctggacccctctcctgcctcccctcctctactttctgcacagtctctgacggccctctatgacgctgacacacgcccacccgtcggtgtcacgtcgaccccagggaaccaaacggccgaaggtactacctaccgtcggccgtaccggganacgttacgactaaacgtttaacgaaaaaaccttaaaaaaaaaattcgttacgttaacttttaaagttacgggtaacccaaggaccaaaggtaacgtaccgaacgggacccgaaccggggtcccctgggtccgtcgtacggtactaacgttacgaacggacgaacgagaccgacgacccgtacccggtcggtacctccgtagaagtacgtatttccggacgtcggtacctacgtacggttaacggaacgtaaactacggtcccgtaaccttaccggtttaacgaccgttcgggttacggacggggttaccggggacccgtaagggggtaccgggtaagggtaaggaacggtaacgtacgggtaacgtaaccgtttaagttaacccgttagttaacccgtaaacgaaacggtaacgtaacgttaagggttaacgtttacgggtttaaccacgggttaccggggttacgggttacgggttaacccggggacccgggtaaagggtcccggtaaacgggtacccggttaaacccgggtcccgggtaccggtttaaccggggaccccgttaaaccgggccccgtaaccgggtccccggtaaccccggttccccccggttacggtacccccttccgtttacccccggtcccggtttacccccccg

SEQ ID NO: 147699 - DNA, 833 bp, Homo sapiens
  misc_feature: GYAE6OF01DLD4T.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggggctcaggaggcagagctctgggaatctcaccatggcctggaccctctcctgctccccctcctcactttctgcacagtctctgaggcctcctatgagctgacacagcccaccctcggtgtcagtcgtcccaggaccaaacggccaggactcacctgcctccggagatgctattagaaccaaaaaaatntgactttattcggtaccagcaagaacgtcacggccacggccctgtcgctggtcatactacgagacagcacggaccgacccgtccgggactcccgtaggacgtacgtattccgtcgtcggtacctccgtaggttaccgaacggggtaaactaaacggtcggtaccccaaccggttttacggaccgtttacggtaccggtacggggttccggggggaccccgtaaggggttcggggaacggtaggtagggaaacggtccgttaacggtaaccttaaccgttaccggttacgtttaacctaaccgaaaccgtaacggtaacgtaacgggtttaacggtttaggggtttaaccttacggttaacggtttaggggggtttacccgggttaaccgggggtaccggggttaacccgggggtaacccgtaacgggtacccggtttaccgggaaccccgggtttccgggtacccggggttaaccgaacccggggtaccccggtaaacccggggtcccgttacccccgggttcccccccgtaccgggttacccccgttaccgtttccccgttccccggtttccccccggttaccccc

SEQ ID NO: 147700 - DNA, 1002 bp, Homo sapiens
  misc_feature: GYAE6OF01ARCWZ.26.67.G01.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgacgctgacacacgcccacccgtcggtgtcacgtcgtcccccgaggaaccaaaccggccaaggactccacctgccgtccgganatgacagttacgaaaacctaaaaaaaatntacgtactttaagttacggtaaccaaggacaagaacgtcgacggacccgaaccggtccccttggtacggccgttacggtacctagttacccgtaacggaacggaaccacggtaccgaacgggaaccccgtacccccggttacccggggtactaccccggtaaggaacggtaacgttaccgtttccgtaccggtacggtccctaacccggttaacggttaacccggaacggggtaaaccctaaacgggttcccgggtaaccccctttacccggttttaacggggtaaccccgtttagggtacccgggtaaacgggggggttcccggggggaaacccccgtaagggggggtttaagggggaaccggggttaaacggtaacgggtaaaaccggtttacccggttaacgggtaaaccctttaaacccggtttaaccgtttaacgggtttaaaacccgtaaaccgtaaaaccggttaggaaaccggtttaagggtttaacggtttaacggtttaaccgtacccggttaaccggggttttcgggggtaaccggttttacccgggggaacgggggtaaccggtaaacccgtacgggttacccgtacccgggtttaaccccgggtaccgggtttaccgggaacccgaaccccggggtaaccccgtaacgggttcccccgtcccggtaaccccccggttcgggtaacccttacccgttacccgttccccccggtaacccccc

SEQ ID NO: 147701 - DNA, 866 bp, Homo sapiens
  misc_feature: GYAE6OF01BDJ2Z.26.67.G01.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagctgacacacgcctacctcggtgtcagtcgtcccaggaacaaacgcaggntcacctgctacgganatgctattacgaaacctaaaaaaatctagtactttagttacggtaaccgagactaaggaacgtcgaacggcccgaacggtcccctggtacgtcgttggtaccaagtttaccgacggacgggaactacgacgaaccggaccgtaccccgtcgggtaaccttcccgaggaaacgtagttaccgttacgttcgtcgtacctacggtacgttacgaacgggtacaacgtcgtacctacgtgtaacgtcgtccggtaagggttccggggaccgtacggggtagggtaacgggtacgtaggtaaacgtcgttaacgtaacccgtttaacggttacgttaacggttaaacctaaccgaaaccgtaacggttaaccggtaggttttaacgggttaacggtttaacgttaaccgggtacgggggttttacgggttccgggggttaacccgggaaccggggtaaccgggggtaaacccctaaacgggttccccggtacggggttaaccccccggtttacggggtaacccggggttacccgaaaacccgggtaccccggtaaaccgggtaccccggttcccccggtaacccccgggtttaccgggttaacccttaacccgtttccccggtttacccggtttaacccccccccg

SEQ ID NO: 147702 - DNA, 934 bp, Homo sapiens
  misc_feature: GYAE6OF01CR4O8.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctcccctcctctactttctgcacagtctcgtgacggcctctatgagctcgacacgacgccctacccgtcggtgtcgacggtccgtaccccgaaggaaccgaaaccggccgaaggactaccgaccgtcgaccgtaccgggagtagtacgactaacgttaacgaaaaacctaaaaaaattcgtacgttactttaacgttacgggtaaccacggaacgtaacggtaacgtaccggaacgggtaccccgaaccgggtcccccgttgggttccggtcggttacggggttacctaacggtttaaccgtaaacgggaaccggaaccgaacggacccgtaaaccgggaaccccggtaccccgggttaccggggtaaccttaccccgtaagggtaacggtaaacgttctttacccggtcgttccggtaccgttaccggtaacggttacggaacggtaacaggtacccgtacccgtaacgtttggtaccgttcggtacggtacggggtacccgggtaccggtaaggggtaccgggaaggttacggtaaaggtaccgtaacggttaacgtaacccgttaacgtttaccgttaacgttaacctaacgaaacgtacggttaactaagggttacggttaagtttaacgttaccggttaggtttacggggtcggtttaccggggaacgggtaacggtaaccgtaacggtcggtaccggttacccggttacggtaccggggtaccaccgggtaaacccgtacccgggtcccgttaccccggtaccccggtttacggtaccccttaacccgttcccggtttacccgttacccccccg

SEQ ID NO: 147703 - DNA, 854 bp, Homo sapiens
  misc_feature: GYAE6OF01BTXEC.26.67.G01.1.454.CMB.1.raw
  modified_base (258)..(258): a, c, t, g, unknown or other
  misc_feature (258)..(258): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccaccctcggtgtcagtcgtccccgaggaccaaacggccaggatccacctgccgtccggagatgactattacgaaacctaaaaaaatntgtactttaagttaggtaacccagtaccaaaggtaacgtccgaacgggaccccgaacgggtcccccgttggtcggtccgttcgggttaccaacgtttaccgtaacgggaacggaaccaacgggaccaaccgggaccccggtaacccccggtaccggggtaaccttcccgtaggaacgtacgtacttcgtcgtcggtacctcgtacgttacgaacgggtaacctaggtccggtaccctaccgttagtacgttcggtacggtacggggtcccgggaccgtaaggggttagggaacggtagtacggaacggtcttaacggtaaccgtttaaccgttaccggtttacgttaaccctaaccgtaaacgtaacgtaaggttacggtttaggttacgtttaacgttaccggtacggggttacggggtttacgggttaccggggacgggtaaccgggaaccgtagggttacccgtacgggtccccggtttacgggtccgggtaaccacccgggtacccgggtaaccggttcccccgtaccccggggttccccgtaccgggttaccccttacccggttccccggtttccccggttacccccccgg

SEQ ID NO: 147704 - DNA, 776 bp, Homo sapiens
  misc_feature: GYAE6OF01ACSUV.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattgaaccaaaaaatntgcttattggaccagcagaagtcaggccaggcccctgtgcgtggtcatcgtacgagacagcgagaccgacccgtccgggactcccgtagacggagtactttcctcgtcggtacctccgtaggtttccgagggactaagtcggaccctaccgttagacttcggtcgacgggtccggggacccgtaggggtagggaagggtacgtaggaaacgtcgtaacggtaaccttaaccgttacgttacgttaacccgtaacgaaccgaacggtaacgtaacggttacggttagggtttaactaccggttacgggtttacgggggtttaccggtttaccgggggtaacccgggtaaacgggtaaaccccgtaagggtacccgtttaaccggggtaaccccggtttaccgggttaccggggtacccgtaacccgggtacccccgggtaaacggggttcccccgtttaccccgggtacccccccgggtttaccgggttaccccttaccccggtttccccggtttcccccggtttaacccccccc

SEQ ID NO: 147705 - DNA, 789 bp, Homo sapiens
  misc_feature: GYAE6OF01CHI4Q.26.67.G01.1.454.CMB.1.raw
  modified_base (213)..(213): a, c, t, g, unknown or other
  misc_feature (213)..(213): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccacccgtcggtgtcagtcgtcccgaggaccaaacggccagganccacgtgcgtccggagatgctattacgaaacctaaaaaaatcgtacgtcttttaagtacggtaacccaggacgaaggtaacggtccgaacgggtacccgacgggtcccctggtcgtcgtcggtacctacgtccgtaacggacggacgacgcgtaacggaccgacccggtcggactccgagagtactcttcctacgtcgaccttcgacgtcgaacggactaagtcccgaccctacgtctacgttcgtacgggtaccgggtccggggtaccgtaggggtacgtaaggtaacgtaggaacgtccggtaactaaccgtttacgtacgtttaaccgttacgtaacaacggtacgaacgtttaagggtacggtttacggttaaccgtacggttacgggtttacggggttaccggtaccggggacggtaacggaaccggttacgccggttaaccgggtccggttaccggttaccgggaccgtaccgggtaacccggtaccgggttacccccttccccggggtacccccgggtttacgaccccgtttaccccgtttcccggtttcccccgggttaaccccccgg

SEQ ID NO: 147706 - DNA, 690 bp, Homo sapiens
  misc_feature: GYAE6OF01A299H.26.67.G01.1.454.CMB.1.raw
  modified_base (261)..(261): a, c, t, g, unknown or other
  misc_feature (261)..(261): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
tcagagactatactcacgaccggtgctcgatttagagtatacatattgggtttgggggtgggctcaggaggcagagctctgggaatctcaccatggcctggaccccctctcctgcctccccctcctcactttctgcacagtctctgacggcctcctatgagctcgacacacgcccacccgtcggtgtcagtcgtcccgaggacaacggccaggactcacctgccgtccggagatcgactattacgaaaacctaaaaaaatntagtacttagttacggtaaccagcaaggaagtccgacggcccacggcccctggtcgtctggtcataccgtacgacggacganaccgacgaccgacccgtcgggactccgnggacgatcttcgactcgcgtctaggtacgagggacagtcgacctacgtgtaccgtgtcggtacgggtccgggaccgtaggggtaggaggagtaggaacggtctacgtacctacgtacgttacgtactaacgaacgtagatagggttacgttaggtactggtacgggtttcgggttcgggtcgtaacgggggaccggaactacgggtaccgttccggtaaccgggttcccggcgggtaccacccggggtacccgtacggtccccgtacccggtcccccgttacgggacccctttaccgttcccgttcccggtaccccccc

SEQ ID NO: 147707 - DNA, 726 bp, Homo sapiens
  misc_feature: GYAE6OF01BBZ97.26.67.G01.1.454.CMB.1.raw
  modified_base (245)..(245): a, c, t, g, unknown or other
  misc_feature (245)..(245): n is a, c, g, or t
  modified_base (393)..(393): a, c, t, g, unknown or other
  misc_feature (393)..(393): n is a, c, g, or t
tcagagactatactcacgaccggtgctcgatttagagtatacatattgggtttgggggggctcaggaggcagagctctgggaatctcaccatggcctggaccctctcctgctcccctcctcactttctgcacagtctctgaggcctcctatgagctgacacagccacccgtcggtgtcagtcgtcccaggacaaacggccaggactcacctgctccggagatgctattacgaacctaaaaaaatntacgtacgtttagttcggtaacccagacgtaaggaacgttaccgaggacccacggtccctggtcgcgttcggtacactaccgtaacggaggaccaggtaccgacggaccgtaccccggtcgggtactacccgtaggaacgtaacggtntttccgcgttacgcttaccgtacgttcgaaggtaacacgtcggtaccctacgttagacgtcggtacgtacgggtccggggacccgtaggggtacggaggtagtacggaacgtcgtaacggtacttaaccgttacgtacgtttaacgctaacgaacgtacggttaggttacgttacgtaattacgtcggttagggttcgggtacgggtcggaccgggtaacgtacggtccgtcggtacccgttcggggaggtaccgaccggttacccggacggttcccgtacccggtcccccgtacggttaccctacgttccccgttcccgttcccctaccccg

SEQ ID NO: 147708 - DNA, 663 bp, Homo sapiens
  misc_feature: GYAE6OF01CDOON.26.67.G01.1.454.CMB.1.raw
  modified_base (164)..(164): a, c, t, g, unknown or other
  misc_feature (164)..(164): n is a, c, g, or t
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacanagcccaccctcggtgtcagtcgtccccaggacaaacggccaggatcactgcctcggagatgcattacgaacctaaaaaatntgtctttattacggtaaccagacaagaaggtcacggccaccggccctgtcgcgtggtcactacgtacgagggacacgacaaggacccgcccgtaaaaaccggctccgagagngtattctcgtcgtctcgtacgtcgaggacacgtcgaccctactgactgtcgacgggtcgggccgtagggtcggaggagtaggaacgtcgtacgtacttacgttacttacgtttaacctacaaccggaactaacgtaggttagtttacgggttaacttacgtacgggttggggttcggttacggggacgggtacgggacgtaacggtccgcggtacccggttccggtggtaccgtccggaccggtaccgtaccgtcccggtacccccgttcggaccttaccgttcccgttcccttcccccggtaccc

SEQ ID NO: 147709 - DNA, 753 bp, Homo sapiens
  misc_feature: GYAE6OF01BZXEB.26.67.G01.1.454.CMB.1.raw
  modified_base (135)..(135): a, c, t, g, unknown or other
  misc_feature (135)..(135): n is a, c, g, or t
  modified_base (513)..(513): a, c, t, g, unknown or other
  misc_feature (513)..(513): n is a, c, g, or t
tcagagactatactcacgaccggtgctcgatttagagtatacatattggggtttggggggggctcagggaggcagagctcgtgggaatctcaccatggcctcggaccctctcctcgctcccctcctctactttcngcacagtctctgacggcctcctatgagctagacacgacgcccacccgtggtcgtctacggtccgtacccgaagggaacgaaaccggccgaggactccgaccgttcgccggtaccggagtagtcgactaagttaacgaaaacctaaaaaagtcgtagttacgttaggttacggtaacaagtactaaggaacgtccgacggtaccgacccggtcccgttagtcggtccgtacggttcgtacgtacgtacggacgacgcgacgtaccggacccgaccggtccggaccgtcgaacgtgtagtcgtcgtcgtcgtcgtacgttcgacggacggtactacggtccgaacctgttacgtacggtcgagggtcggtcggggacggnggtaggtaaggtagtacggacgttcgtaacgtaccgttaacgtaacggttcctaaagtaccgaagtagtacgtaggtttacggtactacggtacggtcgggtcggggtttacggaaccggggtacgacgggtaccgtcggttacggccggtaccgggttacgggttacggcacccggtaccggtcgtcccccggtcccggtaccctggttaccaccccttcggttccccgtacccgtacg

SEQ ID NO: 147710 - DNA, 611 bp, Homo sapiens
  misc_feature: GYAE6OF01C4NI2.26.67.G01.1.454.CMB.1.raw
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
tcagagactatactcacgaccggtgctcgatttagagtatacatattgggtttgggggtgggctcaggaggcagagctctgggaatctcaccatggcctggacccctctcctgcctccccctctcactttctgcacagtctctgaggcctcctatgagctgacacagccaccctcggtgtcagtcgtccccaggacaaacggccaggatcacctgctccggagatgcattgaaccaaaaaaatntgcttatggtaccagcagatcagccaggccctgtnctggtcatcacgaggacagcagaccgacctccgggaatcccctgagagaatttccgcttcggcttcccgagttacgaagggaccaaagtcggacctacccgttgactgtaccagggttcggggcccgaggtcgggaggagtggtaaagcgtgaacgtactacgttagttactacgaacaagactagtacggtgttaactgacgttagggtcggtttcggacgggacgggaaccaaggtcgtacggtaccgtcccggtcgggtaccacggtaccccgacgggtccgtaccggtcccccttcggtacccgtactcccgttccggtttcccccgg

SEQ ID NO: 147711 - DNA, 673 bp, Homo sapiens
  misc_feature: GYAE6OF01EBD6R.26.67.G01.1.454.CMB.1.raw
  modified_base (243)..(243): a, c, t, g, unknown or other
  misc_feature (243)..(243): n is a, c, g, or t
  modified_base (336)..(336): a, c, t, g, unknown or other
  misc_feature (336)..(336): n is a, c, g, or t
  modified_base (537)..(537): a, c, t, g, unknown or other
  misc_feature (537)..(537): n is a, c, g, or t
tcagagactatactcacgaccggtgctcgatttagagtatacatattgggtttgggggtgggctcaggaggcagagctctgggaatctcaccatggcctggaccctctcctgctccccctcctcactttctgcacagtctctgaggcctcctatgagctgacacagccaccctggtgtcagtcgtccccaggacaaacggccaggatcgacctgcctccggagactgcattagaccaaaaatntgcttattgtacagcagaacgtcacggccacggcccctagtcgcgtcggtcatcgtacgaggtacagcaggacgacccgtccgggactcccgngacgtacggacttcgtcgtcggtcctcccgtacggttacggaaacggggtaacctaacgtcgggacctaccgtttcgaaccgttcgtacgagggttaccggggaccccgtaggggtaaggggacggtaacggtaggtaaacgtcggttaacgaccttaacgtacttacggttaactcaactagacgtagttacgtgtttanacgtacggtagggtcggttacggcgggtacgggaccgaacgtccgtacggacccggttcggtcggtacgtaccggccgggtaacggtccgtcccgtaccccggttacgtcctaacccgtgttcccggttaaccccc

SEQ ID NO: 147712 - DNA, 868 bp, Homo sapiens
  misc_feature: GYAE6OF01EE5AS.26.67.G01.1.454.CMB.1.raw
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
tcagagactatactcacgaccggtgctcgatttagagtatacatattgggtttggggggggctcaggaggcagagctctgggaatctcaccatggcctggaccctctctgctcccctcctcactttctgcacagtctctgaggcctccgtactgagctgacacagccaccctcggtcgtcagtcgtcccgaggacaaacggccaggatcacctnctccggagatgcgatacgaaccaaaaaatntgtacttagttcgggtaacctagtacctaaggtaacgtaccgaacggtacccacggtcccctaggtacgaccgtccggtactacgtacctaacggtaggtaaccaggaccgacgaccggtaccccgtaccgggacttccccgtaggacgtagtacttccgtcgtacggaccttaccggtagttaccggaagggtaaccctaaacggttccggacccgtaaccggtttacgtaacccgtttcggacccgtaacggggtccgggggtacccgtaagggttacgggaagggtacggttaacgggtacggtaccgttacgggtaaccgttaaccgttaacgttaccggtttaacctacgtaaacgtacgtaaccgttaaggttacggttaggtttaactacggttaaccggttcggggttacgggttaccggggtaccggggttaacggggtaacccggtaaacgggttccgggttaaccgggtacccggtttacccgggttacggggttaccggtaacccggtaccccgggtaaaccgggttacccggttccccggacccccccggtttacggttaccccggtacccgtttcccggttttcccccggttcccccggttaccccccgg

SEQ ID NO: 147713 - DNA, 876 bp, Homo sapiens
  misc_feature: GYAE6OF01CYUNN.26.67.G01.1.454.CMB.1.raw
  modified_base (138)..(138): a, c, t, g, unknown or other
  misc_feature (138)..(138): n is a, c, g, or t
  modified_base (296)..(296): a, c, t, g, unknown or other
  misc_feature (296)..(296): n is a, c, g, or t
  modified_base (429)..(429): a, c, t, g, unknown or other
  misc_feature (429)..(429): n is a, c, g, or t
  modified_base (702)..(702): a, c, t, g, unknown or other
  misc_feature (702)..(702): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacngtctctgaggcctcctatgagctgacacacgccctacccgtggtcgtcacggttctcccccgaaggtaaccaaaccgggcctaaggactccctaccgttcgccgttacccgggaagtacgttcgcctaagtttaccgaaaaaccctaaaaaaaagttntaacggttaacttttacgttaaccggtaacccgtaaggaccgtaaaggaacggttaccgaaccgggtaccccgaccggggtcccccttgggtacgtccggttcgttacgtacgttaccgaaggtaccggaacnccggaccgaacccggtacccggtaccccggtcccggtaccttaccccggtaggaacggaacgttcctccgtcgtaccggccttacgacgttacgaccgggtaacgtacggtacccgaccgtttacctacggtaccgttcggtaccggcggggtaccggggtaccgaacggggtagggtaacggtggacggtaacgtcgtaaccgtaccttaaccgttacttacggtttaccaacgtaacgtacggttagtaacgtttacggttacggttaccncgggttacgggtttccgggttacggtcgggtaccgggggtacggacccgtacgttccggaacccggtttccggacccgggttacggtaacctacccgggtacccggaccccggtccccttacccggggtcccccttacggttccgaccccgtttccgttcccccggtacccccg

SEQ ID NO: 147714 - DNA, 864 bp, Homo sapiens
  misc_feature: GYAE6OF01DA6N0.26.67.G01.1.454.CMB.1.raw
tcagagactatactcacgaccggtgctcgatttagagtatacatattgggtttggggggggctcaggaggcagagctctgggaatctcaccatggcctggacccctctcctgcctccccctcctctactttctgcacagtctctgacggcctctatgagctgacacacgcccaccgtcggtgtcagtcgtacccgaggaaccgaaaccggccgaaggactccgaccgtcgccgtaccggaagtatcgactaagttaacgaaaaacctaaaaaaaagttcgtacgtaccgtttaagttacggtaaccgaagtacgaaaggtaacggtacgaaccggacccgtaaccggtcccgttggtacggtcgtggtactacgtaccgtaacggacggaacgacggaccgtaaccggacccggtaccccggtaccgggtaccttcccggaaggaccgtaagtccgttccgtacggtccggtacctacggtacggttaccggaacggtaacgtacgtacggtacccttacgttacggtaccgtcggtacgggtacggggtaccggggtaccggtaggggtacgggtaacggtaaggtaacggtaacgtcggttaacgtaaccgtttacgttacgttacggtaactaacgaacgtacgaagttacggttacggtttacggtaacgtcggttagggttacggggttccgggtacgggtacgggtaaccggtaccggtaccggttccggtaccggacccggggtttcggtaccggtaccgggacccggtacccgggttaccggtaccccggttcccccggtacccggttacccgtaccccgttaccgtttcccccgtcccggttaccccctacccgg

SEQ ID NO: 147715 - DNA, 837 bp, Homo sapiens
  misc_feature: GYAE6OF01DETFP.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctagtgagctgacacacgcccaccgtcggtgtcagtcgtcccgaggacgaaacggccaaggctccacctgccgtaccgggagtactcgctaagttaacgaaaactaaaaaaaatgtacggtactttagttcgaacctaggaacaaggtaacgtcgacggcccgtacggtacccctggtcgtcgtaggtactacgtccgtaacggacggacacggacgtaacgaccggtcccgacgggtactccgagaacgagtctcgtcgtacgcctacgtagttacgaggtactaacgcgtcccgttaacgtacgtacggttcggacggtacggggcccgggtacggtagggtacgggtaaggtagttacggaacgttaccggttaagtacccggttaacttcgtttaaccggtttaaaccgaacgttaaccgaaggtttaacccgttaagggtttaggtttaaccgttaccggttaacgggttaccggggttagggggtttccgggttaccggggaacggggtacccgggtaaaccgtacggttacccgtaccggggttccggtttaccgggtaaccggaccgggtacccggtaaacccccgtacggggttacccccgtttaccccggggtacccccgttaacgggttacccttaaccccccgggttttcgttcccccccgggttacccccg

SEQ ID NO: 147716 - DNA, 847 bp, Homo sapiens
  misc_feature: GYAE6OF01EI56P.26.67.G01.1.454.CMB.1.raw
  modified_base (287)..(287): a, c, t, g, unknown or other
  misc_feature (287)..(287): n is a, c, g, or t
tcagagactatactcacgaccggtgctcgatttagagtatacatattgggtttgggggtgggctcaggaggcagagctctgggaatctcaccatggcctggacccctctcctgcctcccccctcctcactttctgcacagtctcgtgacgcctcctatgagctgacacgcgccctacccgtcggtgtcgtaggtccgtacccccgaggaaccgaaaccggccgaaggtacctccaccgtcgtccgtaccggagagtcgacgtaacgttaacgaaaacctaaaaaatnttacgtactttagttacggtaaccaggacgaaaggtacgtaccggaccggcccgtaccggtccccgttggtcgtccggttacgttacacgttccggaacggtacggaccgacgaccggaacgaccccggtacccgtccgggactccgagagtacgttcttccgtcgtaccgtccgttaacgtaccggttacggacggtaaccgtacggtcccgtacccgttacgttaccggtaggttaccggttacgggtacgggggttccccggaggttaggggaacgggtacgtaggttacgaaggttcccgttaacgttaacccgtttaccgttaaccgtttaaccgttaacccgaacgtaaacggtcgtttaaacggtaggtttaaccggttaaggttaccgttacgggttacgggtttcggggtttaacgggccgggaacggtaacgggaccgtacggttccggttaccggacccgggttgggtacccggtaagcccgggtacacccggggtttccccgccccgttaccgggttcctacgttcccttcccgttcccccgtacccc

SEQ ID NO: 147717 - DNA, 726 bp, Homo sapiens
  misc_feature: GYAE6OF01B9YWU.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagcgtgacacgacgccctacccgtggtgtcaggtcgtcccgaaggaacgaaaccggcaaggactccaccgtcgcgtaccggagtactgactaattacgaaaacctaaaaaattcgtgttacttagttacggtaaccaaggacgaaggtaacgtacgacggaccgtaccggtcccgtggcgtccgtcggtactaacgtccggtacggacggacgtacgaccgacggtaaccggtaccccgtccgggtacctccgtaggacgtacgtcgttccacgtcggtcctaaccgtggttacggacggtaactacggtccgacctaacgttcgaacgtcggtacggtcgggttacgggaccggtagggtacggacgtaggtacggagtacgtacgtaacttcgttagttcgttactacgaacgtagtactaaggttggttagttaacgtgtaacgggttggttcggtacgtacggggaacgtacgtacgacgtccggtacgtaccggtcggacaccggccggtacgtcccgttcccggccccgttactacccggtccttcccggttcctacccccg

SEQ ID NO: 147718 - DNA, 745 bp, Homo sapiens
  misc_feature: GYAE6OF01DGMRK.26.67.G01.1.454.CMB.1.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagctgacacacgcccacccgtcggtgtcagtcgtcccgaggaacaaacggccaggactccaccgtgccgtccgggagactgacattacgaaaccaaaaaattnagtacttagtacggtaaccagactaggaacgtcgacggccaccggtcccngtcgcgtggtacncttacgacggacgacncgacaaccggaccgacccgtaccggtactcccgtaggaacgtagtacttcgtcggtcgtaccgtacgtacgtcgaaacggtacaacgtcggtacctacttcggtacgttcgtaggacggggtacgggacccgtagggtcgggaagtacgtacggtagtaccgttacggtaaccttacgtaacgttacgttactaactaacgaacgtacgtaagggttacgttagttacgtaccggtagggttcgggttacgggcgggtaacgggtacggtacggtaccggtaccgtaccgggtaccgttcccggggtaacggtacccgaccgggttacccggacccgggtcccgttaccccggttaccccggtaaccggttcccgttaacccgttcccgttccccggttcccccg

SEQ ID NO: 147719 - DNA, 793 bp, Homo sapiens
  misc_feature: GYAE6OF01ALG6C.26.67.G01.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgaccacacgcccacccgtcggtgtcagtcgtcccaggacaaaccggcaggatccacctgccgtccggagtntgctagttacgaaacctaaaaaaatnttgtacctttaagttaccggtaccacgacgtaaggaaacgtccgaccggaccgtaccgggtccccttacggtcggtccgttcgggttacctacgttaccggtaacggaacggaacctacggacgtaaccggtacccggtacccccggtaccggggtacctaccccggtaaggacggttaacgtcgtttaccctcggtccgtccttacgtacggttacggaacgggtacctaacgtccggtacccttacgttacgtacgttcggacggtcggggtccgggtaccggtagggtacgggaaggtacggtagaaccggttccgtacgttaaccgtttacgttaacgttaccggttaaccaacgtaacgggaactaacggttaaggttacggttacggttacgtaccggttgggtacgggtttacgggtacggggacgggtaacggacgtcgtaccggtcggtacccgtcggtacggccgaccggacgtacggcccggtcccgtcggtaccgtctaccggttcccgtcccgttccccgtcccg

SEQ ID NO: 147720 - DNA, 773 bp, Homo sapiens
  misc_feature: GYAE6OF01BSFFS.26.67.G01.1.454.CMB.1.raw
  modified_base (168)..(168): a, c, t, g, unknown or other
  misc_feature (168)..(168): n is a, c, g, or t
  modified_base (261)..(261): a, c, t, g, unknown or other
  misc_feature (261)..(261): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagctgacacncgcccacccgtggtgtcagtcgtcccgaggaacaaacggccaggactccacctcgccgtaccgggagatgctagttacgaaacctaaaaaatntagtactttagttacggtaccagacaaggaacgtcgacggcccacggtccccgtgtcggcgttaggtactacgttacggtaacggaaggtaccgacggtaccgaaccggacccggtaccccggttacccggggtaccttaccccggtaaggaacggtacgttacgttccgtcggtcggtacctccgtacggttacgaacgggaactacggtccgtaccctacgtttcgacgttcggtacggacggggtcgggaccggtagggtagggaggagtaggagtcgtacgacttactacgttacgtactacaacgacggtaacgtaggttacgttgttaacgttcggtacgggttgggttcgggttacgggacgggtacgggaactcggtaccggttaccgggtacccggttcgggtacggtacccggtaaccggacccgggttaacccggtcccggttacccccggttccccggttaccggtacccttaccggttcccgttccccgttaccccccg

SEQ ID NO: 147721 - DNA, 873 bp, Homo sapiens
  misc_feature: GYAE6OF01DHZDC.26.67.G01.1.454.CMB.1.raw
  modified_base (270)..(270): a, c, t, g, unknown or other
  misc_feature (270)..(270): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgagcctctatgagctgacacacgcccacccttcggtgtcacgtcgtccccgaaggaaccaaaccggccaaggactaccgaccgtgccgtaccggagactgaccattaacgaaaacctaaaaaattntacgtactttagttacggtaaccacggacaaggaacgtacgacggcccgtaaccggtccccgttaggtcgcgttcggtacgtacgttaccgtaaggacggacgaacggaccgaaccggacccggtaccccggtaccgggtacctacccgtaggaacggtacgttacttccgtcggttacggtccccgtttaccgtaacgggtttaccggaagggtaaacctaacggtcccggtaacccttaccggttagtaccgttcggtacggtaccgggggttcgggacccgggtaggggtacgggaaggtaggtacggtaacggtacgttacgtaaacccgtttacgtttaacgtttaaccgttaaacgtaccgtaaacggaataacggttaacgggtttcggttaaattttaccgtaggggttaccggtttagggggttaccggtttaaccgggggaccgggttaaccggggaaccttaaccgggtccgttaaccgggtaccccgggtagggtacccgggtaccaaccgggtacccgaacggttccccgttaccccggtcccccgtacggttacccgtttacccgtcccggttcccctttaccccccgg

SEQ ID NO: 147722 - DNA, 860 bp, Homo sapiens
  misc_feature: GYAE6OF01C3CVJ.26.67.G01.1.454.CMB.1.raw
  modified_base (143)..(143): a, c, t, g, unknown or other
  misc_feature (143)..(143): n is a, c, g, or t
  modified_base (167)..(167): a, c, t, g, unknown or other
  misc_feature (167)..(167): n is a, c, g, or t
  modified_base (506)..(506): a, c, t, g, unknown or other
  misc_feature (506)..(506): n is a, c, g, or t
tcagagactatactcacgaccggtgctcgatttagagtatacatattggggtttggggggggctcgaggaggcagagctctgggaatctcaccatggcctcggacccctcctcctcgcctcccctcctctactttctgcacgngtctcgtgacgtcctctatgagcncgacacacgcccaccgtcggtgtcgtacgtccgtaccccgaaggaaccgaaaccggccgaaggtactaccgaaccgtcggaccgtaccggagtacgttcgactaactaaacgaaaaactaaaaatgttacgtacttaacgttacggaaccagaccgtaaaggacgtccgaacggccgaccgtccgtggtcgcgtacgctacgtacggacgaacgggcacggaccgaaccggacccgtaccggtaccggtactaccgtagtacgtaaccgttcgttacgtccgtacgaccgtaacggtacggtaccggaagtaaacccgtggccctacgttaccggttanaccggtcggtacgggaccggggtaccgggttaacggaggggtacggtaagtacgtaacggtaacgtaccgtaacgttaacctttaaccggttacgttaaccgtaaccgtaaacggaacgtaacgttaaaccggttagggttaccggttaacgggttaccgttaaccgggtgggtttaccggggttcggaacccggggttacggaaccgggtacgttaccggtcgttaccgggtaccgttacccgggacggttaaccggaccccggtaacgggtccccggttaccccgttaccgtacccccgggttacgttacccggttaccccgtttaccccgggtccgttacccccgttaacg

SEQ ID NO: 147723 - DNA, 785 bp, Homo sapiens
  misc_feature: GYAE6OF01DFK34.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatccacctgcctccggagatgctattgaaccaaaaaaatntagcttatggtaccagacagaatcgacggccaacggcccctaggtcgacgttcgggtctaacgtaccttaacggacgggtacacggaccgaacggtaaccggaccccgttaccggggtaccttaccccgtacggtaacggaacgttaacgtttccgttcgttacggggtcccttaacccgtaggtttaccgaacgggggtaaacctaacggtttaccggggaccccttaaacgttcggtaaccgttcgggttaccggtaacggggtttcgggggaccccggtaggggtttacggggaacgggtaacgttagggaacgtaccggtaggtaacccgtttaacgtaaccgttcggtttaaacgtacccgtaaacgtacgtaaccgtaggttacggttaaggttacgtaccgtaaggttcggggttacgttcggggtacggtacgggaccgtaacggtacgtacggtccgtaccggtcgggtacaccgacccgtaaggccgttaccgtccccggtacggtccaaccttcgtccgttaccccgg

SEQ ID NO: 147724 - DNA, 753 bp, Homo sapiens
  misc_feature: GYAE6OF01BMQ2S.26.67.G01.1.454.CMB.1.raw
  modified_base (172)..(172): a, c, t, g, unknown or other
  misc_feature (172)..(172): n is a, c, g, or t
  modified_base (276)..(276): a, c, t, g, unknown or other
  misc_feature (276)..(276): n is a, c, g, or t
tcagagactatactcacgaccggtgctcgatttagagtatacatattgggtttgggggtgggctcaggaggcagagctctgggaatctcaccatggcctggaccccctctcctgcctccccctcctcactttctgcacagtctctgacggccctcctatgagcgtgacaacncgcccacccgtcggtgtcgagtccgtaccccgaaggaaccaaaccggccaggactccgacctgcctccgggagagtgactagttacgaaaaacctaaaaaaatntcgtacttagttacgtaaccgagacgaagacgtacgaaggcccgaggtccccgtgtcgtcgtggtctagtccgaacggagaacagacgaacgacccgacccgtcgggtaactccccgtaggaagtacgtactttcgtacgtacgccgttacgtacgttacgacgggaaacaacgtccggtacctaccgttgaacgtcggtacgtacgggtccgggaccgtagggtagggacggtacgtaaggacgtacgttaccgtaacgtttaaccgttacgttacgttaacctaacgtaaactacgaagtaaaggtttacggtttaggttaacgtaccggtttcgggtacgggtttgggttacccggggacgggaacgtaaccgtcggtaccgtaccggttccggtaacgtcggtaccggacctacccggacgtacccgcccgtaccccggtcgaccctttccgtcccgttcccgttccccccgg

SEQ ID NO: 147725 - DNA, 741 bp, Homo sapiens
  misc_feature: GYAE6OF01AW9P4.26.67.G01.1.454.CMB.1.raw
  modified_base (262)..(262): a, c, t, g, unknown or other
  misc_feature (262)..(262): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgaggcctcctatgagctcgacacacgccacccgtcggtgcagtcgtccccgagggaccaaaaccggccaggactaccaccgtgccgtccggagatcgactattacgaaaccaaaaaatntagtcttagtacggtaccagaccagaacgtcacggcccgacggtccccgtagtcgcgtggtacactaccgtacggaggaccacggcaacggacccgaccccgtaccgggtactccgtaggacgtagtacttcgtactcggtcgtcgtacgttacgaagggtacaacggtcgaccctaccgtttacggacttcggtacgtacgggtccggggaccaggggtagggaacggacgttacgggacgtacccgactaacgttctaccgttaacacgaacgaagtacgtagttagggttacgtcgtaccgtacgggtcgggttacgggtccgggtaacgggacgggtaccgaacggttccgtacccggtaccgggttcccggttacgggtccgaaccgggcccgtaacccgggtccgtccccggttacccccggtacggtaccccctaccgtttaccccgttccccggttcccccgttaaccccg

SEQ ID NO: 147726 - DNA, 777 bp, Homo sapiens
  misc_feature: GYAE6OF01CN3NN.26.67.G01.1.454.CMB.1.raw
  modified_base (252)..(252): a, c, t, g, unknown or other
  misc_feature (252)..(252): n is a, c, g, or t
  modified_base (383)..(383): a, c, t, g, unknown or other
  misc_feature (383)..(383): n is a, c, g, or t
tcagagactatactcacgaccggtgctcgatttagagtatacatattgggtttggggggggctcaggaggcagagctctgggaatctcaccatggcctggacccctctcctgcctccccctcctcactttctgcacagtctctgaggcctcctatgagctgacacagcccacccgtcggtgtcagtcgtccccgaggacaaacggcaggatcacctgcgtccggagatgctattacgaaacctaaaaaaatntgacttagttacggtaaccaaggaaagaagtacgacggaccgacggtcccctggtcgcgttaggtcactcgtaacggaaggacacggacacggaccgaccccgtcgggactccgtagaacgtagtacttcncgtcggtcctaccgtagtacgaagggtacaaggtccgcctacgttgacgttcggtacgacgggtccggggaccgtaggggtacggaggtaacgtaggaacgtcgtacgtaacgttaaccgttacgttacgttaaccgtacgaaacgtacggtaactacgggttaacggttttaggttaacgttacggtacgggtttaggggttacggggttaccggggacggggtaaccgggtaacccgtagggtaccggtacccgggtaccggttacccgggtaggggtacccgtaacccggacccggttaaccgggtccccgttacccccgggtccccccgggttaccgtcccggttaacccgttcccggtttcccccggttccccgtccccggtttaaccc

SEQ ID NO: 147727 - DNA, 769 bp, Homo sapiens
  misc_feature: GYAE6OF01D2ZN2.26.67.G01.1.454.CMB.1.raw
  modified_base (134)..(134): a, c, t, g, unknown or other
  misc_feature (134)..(134): n is a, c, g, or t
  modified_base (240)..(240): a, c, t, g, unknown or other
  misc_feature (240)..(240): n is a, c, g, or t
  modified_base (545)..(545): a, c, t, g, unknown or other
  misc_feature (545)..(545): n is a, c, g, or t
  modified_base (572)..(572): a, c, t, g, unknown or other
  misc_feature (572)..(572): n is a, c, g, or t
tcagagactatactcacgaccggtgctcgatttagagtatacatattgggtttggggggggctcaggaggcagagctctgggaatctcaccatggcctcggacccctctcctgcctccccctcctctactttcngcacagtctctgacggtcctcctatgagctgacacacgcccacccgtcggtcgtcagtccgtacccgaaggaccgaaacggccaggactccacctcgcgtccgganagtgactaagttaacgaaaaacctaaaaaaatgtagtactttaagttacggtaaccagactaaagtaacggtaccacgggtaccgaccggtcccttggtcgtcgttacggtactacgttaccggtaacggaacggaacacggtaccgtaaccggaccccggtacccggttacggaccggtaccgtacgtaacggacgtacgttactccggtcgtccgtactacgtacgtacggaacgttaacgccgtacgtaccgtacgttacgcggtacgtgggtccggggtaccgtagggtaggaacgggttnaggttaacgcgttagactaacccgttntacgtactaaacgagaacgtagttacgggtaagtttaggtcgttaaccgtcggttacgggttccgggtacgggaacgggccgttaacggagtcccgtggtaccgccggtacggttccgaaccgtaccggcccggtacgtcccccgttaaccgggttccggacccttcccggttcccttaccggtacccccttccccg

SEQ ID NO: 147728 - DNA, 707 bp, Homo sapiens
  misc_feature: GYAE6OF01AF125.26.67.G01.1.454.CMB.1.raw
  modified_base (255)..(255): a, c, t, g, unknown or other
  misc_feature (255)..(255): n is a, c, g, or t
  modified_base (384)..(384): a, c, t, g, unknown or other
  misc_feature (384)..(384): n is a, c, g, or t
  modified_base (560)..(560): a, c, t, g, unknown or other
  misc_feature (560)..(560): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacacgcccaccctcggtgtcacgtcgtccccgaggaccaaaccggccaggactcacctgcctccggagatgacgattagaacctaaaaaagttntagtctttagttcgtaaccgagtcaaggtactcgacggccgacggtccctaggtcgtcgtggtcctatcgtacgagacagcgacgaccgcccgtcggtacctccgagacgagtacttctcgtcggtccncgtacgttcggacggactacgtcggtacctaccgtttgacgttcgtacggtacggggtcgggtacccggtaggggtacgggtaagtacggtacggaaccgtcgtacgttaacccgttcgtaacgtttacggtaacctaccgaacgacggtaacgttaggttacgttacgtttaccnggttaccgggttcggggttacggtacgggacgggttaacggacccttaaggtcccgtaccggtccggtcggttacggaccgacggtaccggacggttcccgcccgttacccggcgttaccctcttcccggttccgtcccccgtaccc

SEQ ID NO: 147729 - DNA, 716 bp, Homo sapiens
  misc_feature: GYAE6OF01BKE86.26.67.G01.1.454.CMB.1.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccacccgtcggtgtcagtcgtcccaggacaaacggcagatcactgctcgganatgcattacgaaacaaaaaaatntagtacttagttacggtaccagtacgaaggtaagtccgaacggacccgtacggccccgtggtcgtccgtggtacacgtaccgtaacggacggaaccgaggaccgaaccggacccggtaccccgtccgggtacttcccggtaggaacggtacgtacgttcctcggtacggtccgtaccgtacgttacggacgggtaactaacggtcgaccctaccttaggtaccgtggtcgtacggggtccgggacccgtaggggtacggaaggtagtaggaacgtcgtagaaccttacgttacgttacgttacaaccgtaagaacgtacgtaaggtttagtacgttaacgacggttagggttcggggttcggttaccggggacgggtaaccggaacgagtccggtacgtacccgggtccgaggtaccgacggcccgtaggcccctccggtaccccgtcgtaccgccttccgtcccgtcccc

SEQ ID NO: 147730 - DNA, 694 bp, Homo sapiens
  misc_feature: GYAE6OF01CC1H3.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaacgcaggatcactgctccggagatgctattacgaaacctaaaaaaaaatntagtactttagttacggtaaccagactaagaagtcgacgggaccacggtcccctggtcgccgtaggtctagtccgtaacggacggacacgacgaacggaccgaccccggtaccgggactcccgaggaagacgtattccgtgcggtcctcgtagttacggaaggtacaacggtcggacctaccgttggaccgttggtacgtaggggtccgggtcccgaggggtacgggaggtagtacggaacgtcgtagaccttacgtacttacgttaccacaacgtagaacgttaaggttaggttagttactcgtacgggttggggtacggttcgggacgggtacggaacccgaaggtcgttaccggacccggttcggtacggggtaccacggcccgtaacgggtcctccccggtccccgtacggtaccctacgttcccgttcccggttccccccg

SEQ ID NO: 147731 - DNA, 801 bp, Homo sapiens
  misc_feature: GYAE6OF01B0K7F.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctgcctccggagatgctattacgaaacctaaaaaaatntagtactttagttacggtaccagtacaagtaacgtacgacggacccgacggccccttaggtcgtcgttcggtaccacgttaccgtaacggaacggaccgaggaccgaacgggtaacccgaccccggtcccggggtaacctccccgtaggaacggtacgtactttacctcggtcggtaccttcccgtaaggtttccggaacggggtactaaacggtcggtacccctaacgttcggtacgtcggtaccgtacgggtccggggacccgtaggggttacgggacggtaagtacggtaacgtcgtacggtaaccttaacgttacgttaacggttaacctaaccgtaaacgtaacggtaaccgtaaggtttaacgggtttaggttacgtaacggttacggtttacgggggttcgggttaccgggacggggtaacgggtaaccgaacggtccggtaccggtacccgggttccggttacgggaccgtaccggaccggtacgggtccctcccggtccccgtacggttacccctacgttcccgttcccgttacccctaccccg

SEQ ID NO: 147732 - DNA, 1026 bp, Homo sapiens
  misc_feature: GYAE6OF01BQFGR.26.67.G01.1.454.CMB.1.raw
  modified_base (132)..(132): a, c, t, g, unknown or other
  misc_feature (132)..(132): n is a, c, g, or t
tcagagactatactcacgaccggtgctcgatttagagtatacatattgggtttggggggggctcaggaggcagagctctgggaatctcaccatggcctggacccctctcctgcctccccctcctcactttcngcacagtctctgacggcccctactagtagacgtcgacgaccacgaccgtaccccgtacccggttcggttcgtacgtcggttcccgtacccggaaacggaaccggaaccggaccggaacggtacctacccgtaccgtccggtacccggtacgggtagtacgtacgacttaacgtaaaccgtaaaaaaccttaaaaagttcgtacgtttacgttttaacggttaccgaaccgtacgaacgtaaacggtaccgaccggaccggaccgtaccccggttccgtaggtccgtccggttacgtaactaccggttaaccggaacggtaaccggacgaccgtaaccggaaccccggtaacccccggtacccgggttaccgggtaccctccgggtaaaggtaacgtaccgtttaccttccggtccggtacgtacccgttaacggttacgtaccgggaacgtaacgttcccggtcccgttaaccgttaccgtttagaccggtttacggaaccggggttcgggggtacccgggtacgggttacgggggtacgggtaaggttacgaacgggttaacccgtaccgttaacggtttaacccgtttacttaccggtttaacgttaaccgaacccgtaacggtaacgtttaacgggtttacggttaacggtttcgggttaacctaaccggggttaccggggttacgggtttaccggggtacgggaaccgggtaacgggtaacccgttcggggtaccctcccgggggtttaacccggtacgggtacccgggttacccgacccgggtaaccccggttccggttacccccggttcccccccgggtaccggttaaccggttaccccggttaccccggttttaccccggttccccccgtacccccgggtttacccg

SEQ ID NO: 147733 - DNA, 741 bp, Homo sapiens
  misc_feature: GYAE6OF01B4WLN.26.67.G01.1.454.CMB.1.raw
  modified_base (256)..(256): a, c, t, g, unknown or other
  misc_feature (256)..(256): n is a, c, g, or t
  modified_base (373)..(373): a, c, t, g, unknown or other
  misc_feature (373)..(373): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagctgacacacgccctaccctcggtgtcaggtcgtccccaggaacaaacggcaggatcacctgctaccggagatgcaattacgaaacctaaaaaaatntcgtactttagttcggtaaccacgacaagaacgtcgacggccgacggtcccctggtcgctcggtctatccgtaacggacggacacgcgaacggcccgtaccccgccgggacttccgngacgtacgtacttccgtcgtcggtcctaccgtagttacgacgggaactacgtcgaccctacgttcgacgttcggacggtacggggtcgggaccggtaagggtcgggaaggtacgtaggaacgtcgtacgttaaccgttaccgttacttacgtaccaacgtaacgacgtaacgttaagttaggttacgttacgtacggttacggggttgggttaccggggtcggaccggggtaacggaccgtacgggtccgttaccgggacccggttacggtacgggtacccgaaccggacccggtaacccgggttccctaacccccggtcccggttacccggtacccttaccggttcccccgtccccggtttcccccg

SEQ ID NO: 147734 - DNA, 745 bp, Homo sapiens
  misc_feature: GYAE6OF01BN8M9.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttggggggctcgaggaggcagagctctgggaatctcaccatggcctggaccctctcctgctcccctctcactttctgcacagtctctgacggcctcctatgagctgacacagccacctcggtgtcagtcgcccaggacaaacggccaggactcacctgctacggagatgctattacgaaaccaaaaaatntgtacttagttacggaccagacaagaacgtcaaggccacgggccctggtcgtctggtactagttccgtaacggaggaccaggaccgtaacgaaccggtacccgttaccggggaacttccccgtagggaacgtaacggtactttccgtacggtcggtaccttacccgtaggttaccgaacggggaacctaaacgggttccggacccttaaccggtttacggaaacccgttggttacggacgggtttaccgggggacccgtaaggggttagggaacggttaggtaacggtaaacggcttaacggtaacttaacgttaccgttagttaaaccaccgaacgaacgtaagtaagggttacgttaacggttaacgtccgtaacggttggggttaccggttacgggagggtaccggaacgagtcgttacggacccgtcgtcggggtaccacggtaccctagggcctacccgccccgttcgacccttaacgtccgttaccgtcccgtacccg

SEQ ID NO: 147735 - DNA, 847 bp, Homo sapiens
  misc_feature: GYAE6OF01BE6WR.26.67.G01.1.454.CMB.1.raw
  modified_base (141)..(141): a, c, t, g, unknown or other
  misc_feature (141)..(141): n is a, c, g, or t
  modified_base (250)..(250): a, c, t, g, unknown or other
  misc_feature (250)..(250): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctntgaggcctcctatgagctgacacacgccaccctcggtgtcagtcgtcccaggacaaacggccaggatcacctcgcctccggagatggctattagaaacctaaaaaaatntgtactttaagttacggtaccagtacgaagaacgtacgacggtccaaccggtccccgtggtacggtccgttcggtacaacgtaccgtaacggacggaccgagtaccgaacggacccggtaccccgtaccggggactccccgaggtaaggacgtaacgttccgtacgttacggtccttaccgaacgtttcggaacgggtaactaacggtccggtaccctaccgtttaggtaaccgttcggtacggacggggttacccggggggtaccccgtagggggttacggggaacggtaacggtacgggtaaaccgtcggttaacgtaaaccgtttaaccgtaaccggttaccgtttaaccgaacccgtaaagtaaccggtacgttaaacggtttaagggtttaacggttacgttaccggtacgggtttcggggttaacgggttacggggaccggggtaaccggacggtaaacggtccgttaacgggtacccgttccgggtacggggttccgaacccggtaccggtaaccggcccgttcccgggcccccgtttaccgggtaccctaccccgggttccttcccccgggttacccccgttacccccg

SEQ ID NO: 147736 - DNA, 807 bp, Homo sapiens
  misc_feature: GYAE6OF01CXNDV.26.67.G01.1.454.CMB.1.raw
tcagagactatactcacgaccggtgctcgatttagagtatacatattgggtttgggggggctcaggaggcagagctctgggatctcaccatggcctggacccctctcctgcctcccctcctctactttctgcacagtctctgaggcctcctatgagctgacacagccacccgtcggtgtcaggtcgccccaggacgaaacggccagggactcacctcgcgtaccggagatgactagttagaaccaaaaaaatgtagtacgtttagttacggtaacctagcgaaagtaagtaccgaacggaccgaacggcccgtagtaggcctaggtctatacgtacgaaggacgagaccgtacgaccggtaccccgtaccggggaccttcccgtgaaggacgttacttcgtaccgtggcctacgtaaggttacgagggaactaacggttacggaccctacccgtttaggaaccttggggtacgtaacgggtccggggggaacccgttacgggggtaggggaaacgggtagttaaccggggaaacgtttccggtaacggtaaccgtttaaccggaacgtttacggtttaaccgttaaaccaaacgacggttaacgtaacgggtttaacgggttaacggtttttaaagaaccggtttacgggttacgggggtttacggtaacccggggtagggtaaaccggggaacgttaacgggtccgttaaccggacccgggttacttacgggggtaccacccggaacccggtccgaccgtcccggaccgtcccggtaactcgtaacccttcccggtacctaccccg

SEQ ID NO: 147737 - DNA, 885 bp, Homo sapiens
  misc_feature: GYAE6OF01B6ZWE.26.67.G01.1.454.CMB.1.raw
  modified_base (182)..(182): a, c, t, g, unknown or other
  misc_feature (182)..(182): n is a, c, g, or t
  modified_base (260)..(260): a, c, t, g, unknown or other
  misc_feature (260)..(260): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgacgtcctcctatgacgctagacacagcccacccgtcggtntcagtcgtccccgaggacaaacggccaggactcacctcgctaccggagatgctaagttacgaaacctaaaaaaagttntaggtacctttaagttacgggtaaccagtacgaacggtaacgtaccgaacgggacccgaaccgggtccccttaggttacgccgtacgggttaccattacccgtaacggaacggtacgacggaaccgacggaacccggtacccggtaccgggtaccttaccccggtagggaaccggtaagtttacctttccgtaccggtttcgggtacccttacccggttaacggttaccggtaaacgggtaacccgtaaacggttccggttaaccccttaaccggttttacggtacgttacgggttaccgggacgggttcccgggggtaccggtagggtaaccgggtaggtacgtaacggtaacgtacgttacgtaaccttaacgtttaccgtaagtttaccgaactaaccgtaagtaaccgttaggtaacgggtttacgtaccgttaacgtacggttacgggggttcggttacccgggaaggggtaacccggaacgtaaccggttacccggtacgggtaaccccggttaccggtagggtacccgaacccggtacccggtaacggttcccgtacccgtacccccggttaccggtaccgttaccccgtttccgtccccggttacccctacccccgg

SEQ ID NO: 147738 - DNA, 842 bp, Homo sapiens
  misc_feature: GYAE6OF01CGBPT.26.67.G01.1.454.CMB.1.raw
  modified_base (179)..(179): a, c, t, g, unknown or other
  misc_feature (179)..(179): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggaccccctctcctgctccccctcctcactttctgcacagtctctgaggcctctatgagctgacacagccaccctcggtntcagtcgtcccaggacaaacggcaggatcactgctcggantgctaattagaaacctaaaaaatntagtacttaagttggtaaccagtaccaaaggtaaacgttaccgaacgggtacccgaaccggtcccccgttaggttacggtaccgttagggtaccgaaacgtttcccgtaacgggaacggaaccgaggacccgaacggaacccggtacccccgttaccggggtaaccttccccgtaagggaacgtaacgttacgttccgttacgtcgggtcccttacgtacggtttacggacgggtaactaacgtccgggtccctaacgtttcgacttcggtacggtacgggtaccggggcccgtaaggggttagggacggtaagtacgggaactaccgttaggaaccgtttaaccgttacgtttaacgtaaaccctacggtaaaccgaaggtaaccgttaaggttaggttagggtttaccttaccggtacggtttcggggttacggttacccgggggacggtaacgggtaaccctacggggtacgttacccgggtaccccggttaccgggttcggtaccccggaacggtaccccccgggtaggtaccccgttccccgggttacccccttaccgggtaccttcccgttccccgttcccgttacccccccg

SEQ ID NO: 147739 - DNA, 877 bp, Homo sapiens
  misc_feature: GYAE6OF01EZ7R5.26.67.G01.1.454.CMB.1.raw
tcagagactatactcacgaccggtgctcgatttagagtatacatattgggtttgggggtgggctcaggaggcagagctcgtgggaatctcaccatggcctggacccctctcctgcctccccctcctctactttctcgcacagtctcgtgacggtcctctagtgacgctgaccacacgccccgacccgttggtcgtcacgtccgtaccccgaaggaaaccgaaaccggaccgaaggactacccaccgtcgtccgtccggagagttcgactaacgttaaacgaaaaaacctaaaaaaatgtacgttacttaagttaccggtaccaacgacgaagtaacgtaccggacggacccgaccggtcccttaggtcggtcgttcggtactacgttaccgacggtaacgacgaacgaccgaaccggtaacccggtacccggtacggtacccgtacccgtaaggaacgtacgttaccgttccgtacggttaccggtacctacggttaacggtaacggaacggtaaacccgtaaccggtccggttaacccctacgtttacgtacggtttaccggtacccgggtaaggggttcccgggggaacccgtaggggttaacgggacggttaaacggtaacggtacgttacgtaacggttaacccttaacgttaccgtttacgttaaaccaccgtaaacaccggttaaggttacggtttaacgtaggttaacccgttacgggtaggggtttacgggttccggggtacgggaccggtaacggtaacccgtgggtacccgttaccggtcccgtaaccggttcgaacggtcccgaaccggtaccgttcccgtaccccgttccctacgggtactcccggtttccgtaccccgtacccc

SEQ ID NO: 147740 - DNA, 596 bp, Homo sapiens
  misc_feature: GYAE6OF01CU2OL.26.67.G01.1.454.CMB.1.raw
  modified_base (245)..(245): a, c, t, g, unknown or other
  misc_feature (245)..(245): n is a, c, g, or t
  modified_base (416)..(416): a, c, t, g, unknown or other
  misc_feature (416)..(416): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgcctccggagatgcattgaaccaaaaaaatntgcttattggtaccagcagaagtcgaggccaggcccctgtgcgtggtcatctacgaggacagcagaccgacccgtccgggatccccgtgaggacgtattccgtctgggcctccagttcgagggacaagtcggcctactgactgtcgaggtcgggacccgagggtgggaggngtggaagctagaccttacgtacttcgttacacaacgagactagttagttgttaactcgtacgtgggttgttacgggacgggaggaaccgaacgcgtcgtaccggtccgtcgggtcgacggcccgacggtccgtcccggtccccccgtacggtccctacgttccgtcccgttaccccccgg

SEQ ID NO: 147741 - DNA, 824 bp, Homo sapiens
  misc_feature: GYAE6OF01CWTKN.26.67.G01.1.454.CMB.1.raw
  modified_base (161)..(161): a, c, t, g, unknown or other
  misc_feature (161)..(161): n is a, c, g, or t
  modified_base (434)..(434): a, c, t, g, unknown or other
  misc_feature (434)..(434): n is a, c, g, or t
tcagagactatactcacgaccggtgctcgatttagagtatacatattgggtttgggggtcgggctcaggaggcagagctctgggaatctcaccagtcggcctggacccctctcctgcctcccctcctcactttctgcacagtctctgacggcctctatganctcgaacacacgccctaccgtcggtcgtcagttccgacccgaacggaacgaacggacgaacggtactaccaccgtcgccgtaccggagatacgactataacgaaaacctaaaaaatcgtagtacttagttacgaccaatacgaaacgtagacgacgaccggacgtccgtgtacgtcggtcgtaactacgtaccgtaaggaacgagaaccgacgacggtaacccgtaccccgggtcgtaacgttacccgaggtaacgtaacgttacccgttacncggttaccgtacctacgtaccggtacgaaggaactaggtcccgtaccgttacgtacgaacgttcgtacggtacggggtaaccggtacggacgggttacggaacggtaacgttaacggaacgttaacggtaaccgtaaccgttaaccgtacgttaaccgttaaacgaaccgtaaacggttacgaacgtttaaagggtacggtttaagtttaacttaacggttaccggtaacggggtttcggtaccgggttaccggggaaccgggtaaccggtaaccgtacgtacccgggacgtaccgggtccggtaaggaccccgttaaccggaaccggtaccggtaccccggttcccgacccccggttagtacccccgaacgttccccgggttaaccccg

SEQ ID NO: 147742 - DNA, 815 bp, Homo sapiens
  misc_feature: GYAE6OF01EVRB4.26.67.G01.1.454.CMB.1.raw
  modified_base (261)..(261): a, c, t, g, unknown or other
  misc_feature (261)..(261): n is a, c, g, or t
tcagagactatactcacgaccggtgctcgatttagagtatacatattgggtttgggggtgggctcaggaggcagagctctgggaatctcaccatggcctggacccctctcctgcctccccctcctccactttctgcacagtctctgacggcctcctatgacgctagacacacgcccacccgtcggtcgtcagtccgtaccccgaggaaccaaccggccaaggactccacctgctccggagatgctatagaaaccaaaaatntgtacttagtacgtacagtacgaagagtacgaggcccacggtccccgtgtacggtcgtacggtctaacgtaccgtaacggaaggaaccacgccgaaaccggacccggtaaccccggtaccgggtacttccccggtaggaaacgtacgttaaccgttccgtacgtccggtacctaccgtacggttacggaacggtactaacggtcgtaaccctacgttacgtacgttcggtacgacggggtcgggacccggtagggttacggaaggtacgtaacggaaacgtcgtacgtaaccttacgttacgttacgttaaacctacgaacgtacgaacgttaggttaacggttacgttactacggttacgggtttacggggtacgggttaaccggggaccgggttaacggaaccggttacgtacccggttacgggtaccccggtttacgggtaccgggtacccggaccgggtaaccccggacgggttaccccgttaccccccggtacccgggttaccccgttaccgttacccgtttccccggttaccccgttaacccccccgg

SEQ ID NO: 147743 - DNA, 708 bp, Homo sapiens
  misc_feature: GYAE6OF01EXZRP.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcactgctcggagatgcattacgaaccaaaaaaatntgtactttagttcggtaaccagacaagaagtcaggccgacggccctgtgctgtcatcgtacggaggacgacgcgaacgaccgaccccgtcgggactcccgtagagtagtacttctcgtcggcctaccgtagttacggaacgggactaacggtccggtacccttaccgtcggtacgtcggtacggtacgggtccggggacccgtaggggtacgggaaggtagtaggtaacgtcgtagtaaccttaaccgtacgttacgttaactaccgtaaacgacggtaacgtaggtacggttaggtttaacgtaccgtacgggtttggggttacgggttaccggggacgggtaacgggtaaccgtaacggtccgtaccggtacccgtccggtacgggtaccaccggtacccggacggtcccgtcccggtcccccgttacggtacctacccgttccgttcccgtccccgtaccccg

SEQ ID NO: 147744 - DNA, 808 bp, Homo sapiens
  misc_feature: GYAE6OF01AF2HO.26.67.G01.1.454.CMB.1.raw
  modified_base (270)..(270): a, c, t, g, unknown or other
  misc_feature (270)..(270): n is a, c, g, or t
tcagagactatactcacgaccggtgctcgatttagagtatacatattgggtttgggggtgggctcaggaggcagagctctgggaatcctcaccatggcctggacccctctcctgcctccccctcctcactttctgcacagtctctgacggcctcctagtgacgctgacacacgcccacccgtcggtgtcgagtccgtccccaggaaccaaaaccggccaggactccaccgtcgcctccgggagatgctagttacgaaacctaaaaaattntcgtacgtttaacgtttacgggtaacccaaggaccgtaaacggtaacggtacccgaacggccccgaaccgggtccccccttggacgttaccgtacggtacctagttaccggtaacggacggaccgaagtccgaaccggtacccggtaccccgtaccggggtaccttaccccgaggaccgttacggtactttccggtcgttcggtacccttacggtacgttacgacgggaactacggtcggacccttacgttcgtacgtgtaccggacgggttccgggacccgtaggggtacggtaagtacgtacgggtaactcgtacgtaactacggttacttacggtaaccaacgtacgtacgacgtttaggtaacggtttacgttaaccgtcggttacggtttggggttaccgggttaccgggaaccggggtacggaccgtaggaccggttccggaacccggttcggtacgggtacaccggtaacccggaacggtcccgtccccggtacccgttcggaccttaccgttccggtccccgttcccccg

SEQ ID NO: 147745 - DNA, 784 bp, Homo sapiens
  misc_feature: GYAE6OF01CEIXP.26.67.G01.1.454.CMB.1.raw
  modified_base (269)..(269): a, c, t, g, unknown or other
  misc_feature (269)..(269): n is a, c, g, or t
  modified_base (722)..(722): a, c, t, g, unknown or other
  misc_feature (722)..(722): n is a, c, g, or t
  modified_base (776)..(776): a, c, t, g, unknown or other
  misc_feature (776)..(776): n is a, c, g, or t
tcagagactatactcacgaccggtgctcgatttagagtatacatattgggtttggggggggctcaggaggcagagctctgggaatctcaccatggcctcggacccctctcctcgcctccccctcctctcttctgcacagtctctgacgtcctcctatgagctgacacacgccctaccgtcggtgtcgagtccgtacccgaaggaaccgaaccggacgaggtactccaccgtcgccgtacggagatcgactagtaacaaaactaaaaatntcgtacttagtacggacacgacgtaagtacgtacgaccggccgaccggtccctaggtgtccgtggaccttacgtaacggtaaccggaacggtacgaaccggaccgtaaccgggaccccggtaccccggtaccgggtaccttaccccgggtaagtaacggttacgtaccgttttcccgtacggttcggtaccctacgggttacgttaaccggacgggtaacgtacgtcccgtaccgtacggttcgtatccggtacgggtacgggtaccgggggtacggtacgggtagggtagacggtaacgtacgcgttaaccgtaacgttacttacgttagttacgaactacgaacgtacgttaggtaacgttacgtacttacggtcgggtcggttcgggaccgggacggtaccgagtaccgccgtaacggtcgttaccggcggttaccgcccgggttacccncgggttccccgttccccgaccccggtacttaccgttcccgtcccgttaaccccnccctacgg

SEQ ID NO: 147746 - DNA, 893 bp, Homo sapiens
  misc_feature: GYAE6OF01AD3YZ.26.67.G01.1.454.CMB.1.raw
  modified_base (134)..(134): a, c, t, g, unknown or other
  misc_feature (134)..(134): n is a, c, g, or t
  modified_base (165)..(165): a, c, t, g, unknown or other
  misc_feature (165)..(165): n is a, c, g, or t
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
tcagagactatactcacgaccggtgctcgatttagagtatacatattgggtttgggggggctcaggaggcagagctctgggaatctcaccatggcctggaccctctcctgcctccccctcctcactttctgcanagtctctgacggcctcctatgagctgacacncgcccacccgtcggtgtcngttcgtccccgaggaaccgaaaccggccgaggactccaccgtgccgaccggagntgactattacgaaaacctaaaaaatcgtagtactttagttacggtaaccagacgaaggaagtaccgacgggaccgtaccggcccttggtcgtcgtggtactacgtacgtacggaacgacgacgaccgacgggaacccgtccccggtaccgggtaaccgttcccgaggacgttacgtaagtttcccttacggtcgtacccgtacggttacggtaccggaacggggaaccgttacggtacccggggtacccctttaaccggtttacgggtacccggtttaccgttaacggggtacccggggggtttaccgggggaccccggttaagggggtagggtaaccgggtaggtacgggtaacgtacgtaacgtttaaccgtaacctttaaccgtttacggtttaacccaggtaaactaacggtttaaccggtagggtttaaacggtttcggtttaacggtcggttacggggtttggggttaacccgggttacgggggacggtaaccggggtaactaaccggccggtttacccggttaccgggtccggttccggggaacctacccgggttacccggaccggttcccggtaaccccccgggttcccggtacccggtaccttttccccgggtaccccggttcccccgggtttccccggtcccccg

SEQ ID NO: 147747 - DNA, 731 bp, Homo sapiens
  misc_feature: GYAE6OF01BQYM0.26.67.G01.1.454.CMB.1.raw
  modified_base (139)..(139): a, c, t, g, unknown or other
  misc_feature (139)..(139): n is a, c, g, or t
  modified_base (144)..(144): a, c, t, g, unknown or other
  misc_feature (144)..(144): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
tcagagactatactcacgaccggtgctcgatttagagtatacatattggggtttgggggtgggctcaggaggcagagctcgtgggaatctcaccagtcggcctggaccccctctcctcgcctcccctcctcacctttcngcacngtctctggcggccttcctagtgacgctcgacgaccacgccctaccgtcggtacgtcacgtccgaccccgaaggaaccgaaacggccgaggtactaccgacccgtggccgaccgggatatgactaattaaccgtaaaacaaaaagtntgtacttagtacggaacagacgaggaanccgaacgaccgtccgtcccgtgtcgcgttacgcctaagtcgaacggagaccgacncgtacggacccgaccgtacggcctcgngacgtangttaccncgcgacgtacagtacgacggtaaacncgtacccgtaccgcgttagtaccgnggttacccgggagggttacccggcggagggtacggagttaggacgtacggtacagtacctagttacgtaagtacccaagtaaccagtaacgtgtaagtcgtagtaccggtagtaggggttccggacgggaccgggtaacggtaccgtacggacgttacccgggtccgtccgggttacggacccggacgaacccgggtacccgtcccggtaacccccgtttccggtaccggttcccctaaccgttcccgttaacccccgggtccccc

SEQ ID NO: 147748 - DNA, 539 bp, Homo sapiens
  misc_feature: GYAE6OF01EH3SP.26.67.G01.1.454.CMB.1.raw
  modified_base (163)..(163): a, c, t, g, unknown or other
  misc_feature (163)..(163): n is a, c, g, or t
  modified_base (289)..(289): a, c, t, g, unknown or other
  misc_feature (289)..(289): n is a, c, g, or t
  modified_base (514)..(539): a, c, t, g, unknown or other
  misc_feature (514)..(539): n is a, c, g, or t
tcagagactatactcacgaccggtgctcgatttagagtatacatattgggtttggggggggctcaggaggcagagctctgggaatctcaccatggcctggacccctctcctgcctcccccctcctctactttctgcacagtctctggacggtcctcctatganctgacacacgccctaccctcggtcgtcacgttccgtaccccgaaggaaccgaaaccggccgaaggactaccaccgtcgccgtaccgggagtagtgacctaacttaacgaaaaacctaaaaaaagtntacgtactttagtacgaaccgacgtacgaagaacgtcgaacggacccgaaccggtccgttaggtcgcgttacgggtactacgtacgtaacggacggtaacgccgaacgaaccggaacccgtaccccggtaccgggtacctacccggttagtaacggtactaccgttctccggtacggccgttaccgtacggtacggaacgggactaacgttcccggtaaccccgnnnnnnnnnnnnnnnnnnnnnnnnnn

SEQ ID NO: 147749 - DNA, 771 bp, Homo sapiens
  misc_feature: GYAE6OF01CHLPG.26.67.G01.1.454.CMB.1.raw
  modified_base (141)..(141): a, c, t, g, unknown or other
  misc_feature (141)..(141): n is a, c, g, or t
tcagagactatactcacgaccggtgctcgatttagagtatacatattggggtttgggggtgggctcaggaggcagagctcgtgggaatctcaccagtggcctggacccctctcctgcctccccctcctcactttctgcacngtctctgaggcctctatgagctgacacacgcccacccgtcggtctcgaggttccggtccccgaaggaaccgaaaaccggccaagggtactcctaaccgtcgtccgtaccggaagactggactagttacgaaaacctaaaaaattgttagtttagtacggtacaggtacgaagtaacggtacgacgggtacccgacggtcccgtggtacgtcgtggtacctacgttccgtaacggaacggactaacggacaaccggacccggtacccggtccgggactcccgtaggacgtacgtacgtttccgtcggtacggtccttacgtaggttaccggaaacgggtactaacggtaccggtacctaccgtttacgaccgttcggtacggacggggttacggggaccgtaggggtacggaaggtacgtacgaacgtcgtaacgaacttcgttactacgttacgacaagtacgacgttaggttagttagtctacggtacggttacggggttcggacgggtacggaacggttaccacgggttacgtacgggtccgttacggtcgggaaccgacggaccgtacgggtccgtaaccccgtcccggttcgacccgtactttcccgtcccgttacccctacccgg

SEQ ID NO: 147750 - DNA, 687 bp, Homo sapiens
  misc_feature: GYAE6OF01DUSZT.26.67.G01.1.454.CMB.1.raw
  modified_base (135)..(135): a, c, t, g, unknown or other
  misc_feature (135)..(135): n is a, c, g, or t
  modified_base (217)..(217): a, c, t, g, unknown or other
  misc_feature (217)..(217): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (549)..(549): a, c, t, g, unknown or other
  misc_feature (549)..(549): n is a, c, g, or t
  modified_base (564)..(564): a, c, t, g, unknown or other
  misc_feature (564)..(564): n is a, c, g, or t
  modified_base (617)..(617): a, c, t, g, unknown or other
  misc_feature (617)..(617): n is a, c, g, or t
  modified_base (638)..(638): a, c, t, g, unknown or other
  misc_feature (638)..(638): n is a, c, g, or t
tcagagactatactcacgaccggtgctcgatttagagtatacatattgggtttgggggtgggctcaggaggcagagctctgggaatctcaccatggcctggacccctctcctgcctcccccctcctctactttcngcacagtctctgcgcctctatgagctgacacacgccctacccgtcggtgtcagttcgtcccgaaggaccaacggtcaggacnccaccgtgccgtccggagtatgactaagttaccgaaaacctaaaaaattcgtagttacttaagttacgtacacgtacgaacggtaagacgaccggtacccgtaaccggtcccgtgtcgtcgtcggttactacgtacgtaacggacggaacgtcgaaccgtccgacccggtacccgtaccggtacctacccgtagaacgtacggtactttccacggtcgaccctacgtacggttacggaacggtacctaacgcgacccgttactaggcttaggtccgaggggtcccgggacgtaggggttagaggtaacgngtanccgtaagtacttaccgtntaactcaacagtaancgttaagtcgtaattcgtacggtaggttcggtaggtccggagtaccagaccgntaccggccttcgggactccgngtaacccgcgtcacccccgtcgtcgcccttagtccgttacccgtacccg

SEQ ID NO: 147751 - DNA, 878 bp, Homo sapiens
  misc_feature: GYAE6OF01CW22N.26.67.G01.1.454.CMB.1.raw
  modified_base (136)..(136): a, c, t, g, unknown or other
  misc_feature (136)..(136): n is a, c, g, or t
  modified_base (349)..(349): a, c, t, g, unknown or other
  misc_feature (349)..(349): n is a, c, g, or t
tcagagactatactcacgaccggtgctcgatttagagtatacatattgggtttggggggtgggctcaggaggcagagctctgggaatctcaccatcggcctggacccctctcctgcctccccctcctctactttcngcaccagtctctggacggtcctcctagtgaggctgaccacgacgcccacccgtggtgtcgacggttaccgaccccgaggaacgaaaccgggccgaacggactacctaaccgtcggaccgttaccgggaatcgtacgtctaaagttaacggaaaaaacctaaaaaaaagttctaacggtttacgtttaaacggttaccggtaaaccacgggaanaaacgggtacggttaaccgaccgggtaacccgaccggggttccccgtggtttccggtcggtaacggttaccaacggtttaccgggtaacggacggtaaaccgacggaacccgacccgggtaaacccgtcccccgggtaaccggggtaccttcccgggtaaggtaaaccgacgtttccgttaccgttcgccgggttaacctacgtacgggtaacgaacggttaacgacgggtccgttaacccgcgtttacgggaattccgggtacgggtacccggggtaccggggtacccggtaggggtacgggtacggtaagggtacgtaggtacgtacgtacgttaacgtacgttacgtaacctactaacgtacgtaagttacggttaagtgttaaaccgtcggttaacgggttcgggttacgggtaccgggtaacgggtaaccgggacggtacggtaccggtaccggtaccgtcggttccggacggtaccggacgtcgtccgtcccgccgtacgtcgtccctccgttccgtaccccg

SEQ ID NO: 147752 - DNA, 788 bp, Homo sapiens
  misc_feature: GYAE6OF01CQ64D.26.67.G01.1.454.CMB.1.raw
  modified_base (290)..(290): a, c, t, g, unknown or other
  misc_feature (290)..(290): n is a, c, g, or t
tcagagactatactcacgaccggtgctcgatttagagtatacatattgggtttgggggtgggctcaggaggcagagctctgggaatctcaccatggcctggacccctctcctcgcctccccctctctactttctgcacagtctctgacggcctctatgacgactgaccacgtcgccctacccgtcggtcgacgagtaccgtaccccgaaggaaccgaaaccggccgtaaggactaccaccgtcgtccggaccggagtactgactaagttacgaaaaacctaaaaaagttntacgttacgtttagttaccgaaccgacgagaacggtaacgccggaacgacccgacggtccctgtcggtcgttacgtactacgtacgaaggacgaccacgaccgaaccggacccggtacccgtaccgtacctaccgtaggacgacttacgtccgtacggtcgtacctacgtacgtacgaacggtaacacggtcctaccgtacgtacgtacgttacggaccggttacgggccgggtaacggtagggtacgggtaaggacgtaacgacgtacgttaacgtcctttaaacgtccgtttaactaaccgtaaccgacgtaaacggttacggtaaggttttaacgtacgtacggtacccggtttagggtccgggttcgggtaccgggaacggtccggtaaccggtacgttccgtaacgggtccccggtaacggtcggtaaccgaccggtaccggtcgtacccgtccccggttactaccgttacctcccgttccgtaccctccccg

SEQ ID NO: 147753 - DNA, 837 bp, Homo sapiens
  misc_feature: GYAE6OF01CXH4J.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccaccctcggtagtcagtcgtcccgaggaccaaacggcaggactcacctgcgtccggagactcgacaattacggaaacctaaaaaaatcgtacgactttacgttaaggtaaccacgacaagaacgtcgacggaccgacggccctagtcgctggtctactacgtacgagacgacgtacgacgtaccgacccgtaccggactacccgtaggaaccaggtacttcgtacgtcgggtaccttacccgtaagttacggaacgggtaactaaaccggttccgggacccttaaacggttaggaaccgtttacggtaaccgtagggggtttaacccgggggccccgtaaagggggtacggggtaaacgggtaagtacggtaaacggtaccgttaaccggttaacgttaacccgtttaacggtttaccgtttaaaaccctaccgaaacggtaaccgtaaccgggtaaaggtttacggttacgggtttaattacccgggtaagttcgggggttacgttaccgggggacggggtaaccggaacgaaaccgtcggtcccggtaaccccggttcgggttaaccgggtacggtaacggtaaaccccggaggttcccctaacccccgggttccccgtaacgggttacccttaccccggttcggttacccccgttacccccgg

SEQ ID NO: 147754 - DNA, 697 bp, Homo sapiens
  misc_feature: GYAE6OF01A902T.26.67.G01.1.454.CMB.1.raw
  modified_base (193)..(193): a, c, t, g, unknown or other
  misc_feature (193)..(193): n is a, c, g, or t
  modified_base (279)..(279): a, c, t, g, unknown or other
  misc_feature (279)..(279): n is a, c, g, or t
  modified_base (325)..(325): a, c, t, g, unknown or other
  misc_feature (325)..(325): n is a, c, g, or t
  modified_base (490)..(490): a, c, t, g, unknown or other
  misc_feature (490)..(490): n is a, c, g, or t
  modified_base (532)..(532): a, c, t, g, unknown or other
  misc_feature (532)..(532): n is a, c, g, or t
tcagagactatactcacgaccggtgctcgatttagagtatacatattgggtttgggggtgggctcaggaggcagagctctgggaatctcaccatggcctcggacccctctcctcgcctccccctcctctactttcgtgcactagtctctggacggcctctatgacgctggacacgcgacccgtacccgtggtntacgacgtccgtcccgacggaaccgaaccggccgagactaccgtacctcgcgtaccggatagtcgactagtaacgaaaacaaaatntgtacttacgtacgcagacagtacgtcgagccgacgcctggtacgngtcggtacacgtaccgtagaaccgacgtacgaccgtaccgaccgtaccggcccggatccgacgtacgtactcgttccgactcgctacgttaccggtagaacggtacaacggtaccgccgtaacgtcgaaacgtggacgtacgggccggtacggcggaggtacggngttacgacggtagtaccgttaactaccgtagttaaccgttanacccgtaagacggttagaaaggttacggttagtaacgtacgtcgggtcgggtttaggacggttaacgggacgtaacggtacgtccgtcggttaccgtccggacaccggtacgtcccgacgtccgtcccggtacctacggtcacccggtttcgtcccccgttcccg

SEQ ID NO: 147755 - DNA, 908 bp, Homo sapiens
  misc_feature: GYAE6OF01BI6J2.26.67.G01.1.454.CMB.1.raw
  modified_base (222)..(222): a, c, t, g, unknown or other
  misc_feature (222)..(222): n is a, c, g, or t
tcagagactatactcacgaccggtgctcgatttagagtatacatattgggtttgggggggctcaggaggcagagctctgggaatctcaccatggcctggaccctctcctgctcccctcctcactttctgcacagtctctgagcctcctatgagctagacacacgccaccgtcgtagtcagtcgtacccgaggaacaaacggcaggatccactgcgtcggagntgactaatacgaaaccaaaaaatgtactacgtttaagtcggtaaccaaggactaaggtaacgtaccgaaggacccgagggtacccttggtaccgtacgttggtaccaagttaccgtaacggacggtaaccgaggtaaccgtaaccggaacccggtacccggttacccgggtaaccgtacccgtaagggaacggtaaccttaacgttccgtcgtacggaccgtttacggtaacggtaaccgaacggaaacgttaccggtaccgggacccctttaaacgttacggaaccgttacgggttacggtaacggggtacccggggtaaccgtaaggggtacgggtaacgggtaacggttaaggaaacggttaaccggttaacggtaaacctttaacccggtaacgttttaaccgggtaaacctaaacgtaaaacccggtacgttaaacgttaacgggttaaccggtttaacggtttaaggtaaccccggtttaagggttacgggggtttacgggttaacccggggaacgggttaacgggaaccccggtaaacgtaccgggttaccggttaccggtaacccgggttacggggacccgtaaaccgggtcccgtaaaaccccgggttcgacccccggttccccgttaaggtaccccgttaccgttaccgtttacccccggttcccgtaaaccccgg

SEQ ID NO: 147756 - DNA, 738 bp, Homo sapiens
  misc_feature: GYAE6OF01EF6XA.26.67.G01.1.454.CMB.1.raw
  modified_base (155)..(155): a, c, t, g, unknown or other
  misc_feature (155)..(155): n is a, c, g, or t
  modified_base (166)..(166): a, c, t, g, unknown or other
  misc_feature (166)..(166): n is a, c, g, or t
  modified_base (263)..(263): a, c, t, g, unknown or other
  misc_feature (263)..(263): n is a, c, g, or t
  modified_base (638)..(638): a, c, t, g, unknown or other
  misc_feature (638)..(638): n is a, c, g, or t
tcagagactatactcacgaccggtgctcgatttagagtatacatattgggtttgggggtgggctcaggaggcagagctctggaatcctcaccatggcctggaccccctctcctgcctccccctcctcactttctgcacagtctctgagcctctangagctgacacncgcccacccgttcggtcgtcgagtcgtcccaggaaccaacggccaggactccacctgccgtccgacgagtcgactaattacgaaaaccaaaaaaatnttagtacttaaggttacggtacccaagacaagtacgtacgaccggtccgaccggtcccttagtcgtcgtacgtcctaagttaccgtaacggaggaacgacgtacgaaccggtacccgtaaccccgtccgtaccgtccgtaggtaacgattaccgtctacgtcgcctaccgtagtacgacggaactacgcggtaccctacgtacgacgttggcgtacggggtccggaccgtagggtacgggagtaatcggaaactccgttagaacccttagtaccgtttagtaacctacgaacgtaacttagttacggttgttaacgggtttacacgggttgggttggggtaccgggttaccgggagggttaacccgaggtaaccnccggttaccgccggtttccggacgttacccgaacggacccggttccgcccgacccccggtttcccgacctaccgtttcgtccccggtcccgttacccccg

SEQ ID NO: 147757 - DNA, 686 bp, Homo sapiens
  misc_feature: GYAE6OF01A9LIX.26.67.G01.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (472)..(472): a, c, t, g, unknown or other
  misc_feature (472)..(472): n is a, c, g, or t
  modified_base (674)..(674): a, c, t, g, unknown or other
  misc_feature (674)..(674): n is a, c, g, or t
tcagagactatactcacgaccggtgctcgatttagagtatacatattgggtttgggggtgggctcaggaggcagagctctgggaatctcaccatggcctggacccctctcctgcctccccctcctctactttctgcacagtctctgacggcctctatgagctgacacagcccaccgtcggtgtcagttcgtacccagacagacagccacnctacactgcnganacgaataagtagganactagaancgctgacgtaggttactacgtacggaacggcgaacggtccagttccctttagttcggactactactacaagaagtaagaacgccgaccgtacgacggtactccgtagaaccgttacgttgccggtactaccgaacgttacgacgggtaactaccgacgtacctacgtacgtacgaaccgttacgacgtaccgggacccggtaccgaacgtaaccggtaaaccgggngtaacgggtaagggtaacgtaacgtacttaaacgttcggtaacggtacggggtacgttaaagggtaaccgtaaagttaaccgttaaggtttaggtaacgttttcgggttaacggacggtacggggactacggtacgtacgtacgtacgtacgacgtaccgacggacgtccgaccgcgtccgacttacgtcctacgtaccccnctccgtgttacg

SEQ ID NO: 147758 - DNA, 1013 bp, Homo sapiens
  misc_feature: GYAE6OF01A5AKY.26.67.G01.1.454.CMB.1.raw
  modified_base (133)..(133): a, c, t, g, unknown or other
  misc_feature (133)..(133): n is a, c, g, or t
  modified_base (251)..(251): a, c, t, g, unknown or other
  misc_feature (251)..(251): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttcngcacagtctctggacggcctacctatgagctgaacacacgccctacccgtcgggtcgtacacgtcgtaccccgaaggaaccaaaaccggccgaaggactccaccgtcgccgtccgganctgctaattaacgaaaacctaaaaaagttgtacgtacttttaaggttacgaccgtagacgtaaaggtaacgacgacggtacccgaccgggtcccttaggtacgtccgttacggtacctaacgttaccgtaaacggggaacgacgaccggaacgaaccggtacccccggtaccccggtacccgggtactaccccggtaggtaaccgtagttccctttccggtaccgttaccgggtacccttacgggtacgtaacggggtaacggaacgttaaccggtacccgtaccccgtaccggtttcgtacccggttacgggtaccgggttaacgggggtcccggggtacccgggttaggggtaaggggtaaaccgggttggtaaacgggtacccggtaggttaaccggttaaccgtttaaacccgtacgttttaacccggtaaacctaaccggtaaaccgtaacggtaacgttaaacgggtttacgggtttaacgtttaaccgggaccggttaccgggggtttaacggggtttacccggggttaacggggtaaccggggggtaaacccgggtacccggaaaccgggtttacccgggttaacccgggggtaaaccccgtttccgggggtaccgggtaaccccggaaacccggggttacccggttaaccccggggaccccgtttcccccccgggttaaccccccggggtttccccggttaaccccgttaaccccgggttttccccccggtttccccccgggttacccccccg

SEQ ID NO: 147759 - DNA, 733 bp, Homo sapiens
  misc_feature: GYAE6OF01E4IQP.26.67.G01.1.454.CMB.1.raw
  modified_base (635)..(635): a, c, t, g, unknown or other
  misc_feature (635)..(635): n is a, c, g, or t
  modified_base (697)..(697): a, c, t, g, unknown or other
  misc_feature (697)..(697): n is a, c, g, or t
  modified_base (709)..(709): a, c, t, g, unknown or other
  misc_feature (709)..(709): n is a, c, g, or t
tcagagactatactcacgaccggtgctcgatttagagtatacatattgggtttgggggtgggctcaggaggcagagctctgggaatctcaccatggcctggaccccctctcctgcctccccctcctcactttctgcacagtctctgaggcctcctatgagctgacacacgacccacccgtcggtgtcagtccgtaccccgaggaccgaaacggccaggactccaccgtgcctccgggagactgctagttacgaaacctaaaaaatatcggtactttagttcggtaccagacgaagtacgtcgacggccgaccggtccctggtcggtcgtagtacactacgaacgagacacgacgacgacccggacccgtaccggtactcccgagtacgtacgtacttcgtcgtcgccgtacccgtaggttacgaacgggactacggtccgtacccctacgttacgaccgttcggtacggtacggggttcccgggaccggtagggtacgggagggtactacggtacggtcctaacgttaacctacgtttaccgttaccgtaaccaacgtaacggagtaccggttaagttggttaccgttagacccggttagggtagggtttaccggacgggtagggaccgtaacgnggcggtaaccgtccggtaggtccggtacggaccgcccggtactccccgacccggttccccgnggtttaaccccnccgttccggttacccccggtcccc

SEQ ID NO: 147760 - DNA, 511 bp, Homo sapiens
  misc_feature: GYAE6OF02GOPN5.26.67.G01.1.454.CMB.1.raw
  modified_base (235)..(235): a, c, t, g, unknown or other
  misc_feature (235)..(235): n is a, c, g, or t
  modified_base (327)..(327): a, c, t, g, unknown or other
  misc_feature (327)..(327): n is a, c, g, or t
tcagagactatactcacgaccggtgctcgatttagagtatacatattgggtttggggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctccggagatgcattgccaaaaaaatntgcttattggtaccagcagaagtcaggccaggcccctgtgctggtcatctacgaggacagcagacgaccctccgggatccctgagagattcnctggctccagttcagggacaatggccacttgactgtcagtgggcccaggtggaggatgaagctgactactactgttactcaacagacagtagtggttatcactgggtgttcggcggagggaccaagctgaccgtccgtgggtcagcccgaaggctgcccctcggtccactctcgttccctaccc

SEQ ID NO: 147761 - DNA, 514 bp, Homo sapiens
  misc_feature: GYAE6OF02IATR4.26.67.G01.1.454.CMB.1.raw
tcagagactatactcacgaccggtgctcgatttagagtatacatattgggtttgggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaattgcttattggtaccagcagaagtcaggccaggcccctgtgctggtcatctacgaggacagcagacgaccctccgggatccctgagagattctctggctccagttcagggacaatggccacttgactgtcaggtggggccagggtggaggatggaagctgactactactgttactcaacagacagtagtggttatcacgtgggtgttcggcggagggaccaagctgaccgtcgtgggtcagcccaaggctcgcccctcggtccactctcgtcccaccc

SEQ ID NO: 147762 - DNA, 530 bp, Homo sapiens
  misc_feature: GYAE6OF02JCT7T.26.67.G01.1.454.CMB.1.raw
  modified_base (316)..(316): a, c, t, g, unknown or other
  misc_feature (316)..(316): n is a, c, g, or t
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagagactatactcacgaccggtgctcgatttagagtatacatattgggtttgggggtgggctcaggaagcagcatcggaggtgcctcagccatggcatggatccctcctcctcgcgtcctgctactgcacaggatccgtggccgttccgtatgagctgattcagccaccctccagtgtccgtcgtccccacggacagacagccaccatcacctgctcggcagacaaattgggagatagaaatgctgcctggtattaccagaggccaggccacgtcccctatttttggtcatcttccaagataagaagcgccctnagggatccctgacgaatttctggctccaactcgtgggaacacagccactctgaccatcagccgggcccagccaacggangaggganactactattgcnggcgtgggagaatactagttgtaggtgtttggcgggaggtacaggctcgaccgtccgtaggtccacgcccgaaggctcgacccccgtcggtcactccgttcgtccccacccctctc

SEQ ID NO: 147763 - DNA, 593 bp, Homo sapiens
  misc_feature: GYAE6OF02I9Q2Z.26.67.G01.1.454.CMB.1.raw
  modified_base (251)..(251): a, c, t, g, unknown or other
  misc_feature (251)..(251): n is a, c, g, or t
tcagagactatactcacgaccggtgctcgatttagagtatacatattgggggtttgggggctcaggaggcagagctcgtgggaatctcaccagtggccgtggaccctctcctgctcccctcctcactttctgcgacagtcgtctggacggcctcctatcgagctgacacagcccaccctggtgtcgagtcgtcccaggacaaacggccaggaactcacctgctccggagatcgccattgacctaaaaaatntgacttaattggtaccagcagaagtcaaggaccacggcccctgtagcctaggtcatctacgtagacagcagacgacctccgggactcccagagtacgattctctggctcgagttcaagggtacaagtcggaccaccgttgacctgtccaggtcggggccctagggtcggaggagtgaagcgtacggacgtactacgtagttactacaacgagacagtagtaggttatcgacgtgggtgttcggacggacgggaccgaagtcgttcggaccggtcggtacgggtcacggtacccgaaggtcctacggccccgtcgggtccaccgtcctccggtcccctccccg

SEQ ID NO: 147764 - DNA, 528 bp, Homo sapiens
  misc_feature: GYAE6OF02G26KC.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggatccctgagagattctctggctccagttcagggacaatggccacttgactgtcagtgggcccagggtggaggatgaagctgactactacttgttactcaacagacagtagtggttatcacgttgggtgttcggcgggaggacaagctcgaccgtccgtgggtcacggcccgaaggctcggcccccgtcggtcctacgtcctcgttaccccc

SEQ ID NO: 147765 - DNA, 501 bp, Homo sapiens
  misc_feature: GYAE6OF02IEFQ4.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggatccctgagagattctctggctccagttcaggacaatgccacttgactgtcagtgggccaggtggaggatgaagctgactactactgttactcaacagacagtagtgttatcacgtgggtgttcggcggaggaccaagctgaccgtcgtgggtcagcccagctcgccctcggcactctgtcccc

SEQ ID NO: 147766 - DNA, 512 bp, Homo sapiens
  misc_feature: GYAE6OF02IRE0H.26.67.G01.1.454.CMB.1.raw
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
  modified_base (449)..(449): a, c, t, g, unknown or other
  misc_feature (449)..(449): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagacgaccctccgggatccctgagngatctctggctcagttcagggacaatggccacttgactgtcagtgggcccaggtggaggatgaagctgactactactgttactcaacagacagtagtggttatcgactgggtgttcgggnggaggaccagcgtcgaccgtcgtgggtcagcccgaggctcgcccctcgtcacgtctcgtcccc

SEQ ID NO: 147767 - DNA, 549 bp, Homo sapiens
  misc_feature: GYAE6OF02I3QAJ.26.67.G01.1.454.CMB.1.raw
  modified_base (239)..(239): a, c, t, g, unknown or other
  misc_feature (239)..(239): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgccaaaaaaatntgcttattggtaccagcagaagtcaggccaggcccctgtgctggtcatctacgaggacagcagaccgaccctcgggatccctgagagattctctggctccagttcagggacaatcggccacttgactgtcagtcgggcccaggtggaggagtgagcgtgactactactgttactcaacagacagtagtggttatctacgtgggtgttcggacggtagggaccgaagcgtacgaccgtcgtcgggtcgacggacccgaacggtccgtccggcccccgttcggtcccacgttccgtccgttcccctaccccg

SEQ ID NO: 147768 - DNA, 529 bp, Homo sapiens
  misc_feature: GYAE6OF02HA295.26.67.G01.1.454.CMB.1.raw
  modified_base (239)..(239): a, c, t, g, unknown or other
  misc_feature (239)..(239): n is a, c, g, or t
  modified_base (413)..(413): a, c, t, g, unknown or other
  misc_feature (413)..(413): n is a, c, g, or t
  modified_base (448)..(448): a, c, t, g, unknown or other
  misc_feature (448)..(448): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgacctcgggatccctgagagattctctggctccagttcagggacaagtcggccacttgactgtcaggtcgggccaggtggaggatggaagctagactactactgttacncaacagacagtagtgttatcagtgggtgttcgggnggacggacaagctagaccgtcgtgggtcacgaccgaaggcctccgccccgttcggtccaccttctccgttacccctacccc

SEQ ID NO: 147769 - DNA, 775 bp, Homo sapiens
  misc_feature: GYAE6OF02H2M4B.26.67.G01.1.454.CMB.1.raw
tcagagactatactcacgaccggtgctcgatttagagtatacatattgggtttggggtgggtcgtcaggaggcagagctctgggaactctcgaccatggacctggacccctctcctgccttccccctccttcacctttctgcacagtctcctgaggcctccgtatgagtctgacacagccaccctcggtacgtccagtcgttccccaggaccaaaacggggccaaggactccaccttcgctcccggaggactggctaacttttggacctaaaaaaattattgacctttagttggtaccagaacctaggaacgtcgacggcccacggcccccttgttcgtcgttgggtcacttctaacggacggtaacaggccaacgaccgacccgtccggggatccccgtaggacggacgacgttcgtcgtcggggtcctaccgtaacgtttccgaaggggtaaccaacgtcgggaccctaacccgttaacgaccgttcgtacgtaacgggttcgggggaccccgagggttacgggaaggtaagttacgggaagtaccgttagtaaccttaacgttaaccttggtttaacctacgtaaactacggtaaccgtacggttaggttacgggtttactaccgtaacggttacgggttggttacgggcgggtaaacgggaccaaacggtcttacgggacccgttccggtcgggttaccgaccggacccgtaacggcccgttacccgtcccccgttacggttcccgtaccgttcccgtaccgttccccccg

SEQ ID NO: 147770 - DNA, 515 bp, Homo sapiens
  misc_feature: GYAE6OF02FUNMO.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacatagccaccctcggtgtcagtgtccccaggacaaacggccaggatcacctgctccggagatgcattgaccaaaaaaaaatntgcttattggtaccagcagaagtcaggccaggcccctgtgctgctcatctacgaggacagcagaccgaccctccgggatcccctgagagattctctggctccagttcagggacaatggccaccttgactgtcagtgggcccaggtggaggatgaagctgactactactgttactcaacagacagtagtgttatcgacgtgggtgttcggcggaggaccgagctcgaccgtcgtggtcacgccgaaggctcgccccgtcggtcactcgtccg

SEQ ID NO: 147771 - DNA, 567 bp, Homo sapiens
  misc_feature: GYAE6OF02JHFQP.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgaggcctcctatgagctgacacagccaccctcggtgtcagtgtccccaggacaaacggccaggatcacctgctccggagatgcattgaccaaaaaaatntgcttaattggtaccagcagaagtcaggccagggccccctgtcgctggtccagtctacgaggacaggccagacgaaccctccgggatcccgtgacgagattcgtcttggctccagttcagggtcaagtgcacttgactgtcagtgggcccaggtcgaggatgaagctgactacgtactgttactctaacagacagtatggttatcgtactgggtagtttcggcggtagggaccgaaggcctaggaccggtccgtaggggttccaagggtccccaacgggccgttacggcccccgttccggtcccgtaccgttcctcggttccccc

SEQ ID NO: 147772 - DNA, 521 bp, Homo sapiens
  misc_feature: GYAE6OF02HS17P.26.67.G01.1.454.CMB.1.raw
  modified_base (242)..(242): a, c, t, g, unknown or other
  misc_feature (242)..(242): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (477)..(477): a, c, t, g, unknown or other
  misc_feature (477)..(477): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctagaggacagcagacgaccctccgggatccctgagagattctctggctcagttcagggacaagtcgcctacttgactgtcgaggtgggcccagggnggaggagtgaagcgtgactactactgttactcaanagacagtagtgttatcagtggtgttcggcggaggacgagctgaccgtcgtggtcncgcccgaaggccgtcgccccgtcggtccacgtccgtcgtccccg

SEQ ID NO: 147773 - DNA, 551 bp, Homo sapiens
  misc_feature: GYAE6OF02IM439.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctccgggatcccgtgagagattctctggctccagttcaggacaatggccacttgactgtcgaggtcgggcccagggtggaggatggaagctgactactactgttactacaacagacagtagtggttatcgtagtgggtgttcgggcggacgggaccgaagtcgtcggaccgtccgtgggttacacggtacccgaaggtccgtccggcccccgtcggtccaccttccgttcgttacccccg

SEQ ID NO: 147774 - DNA, 528 bp, Homo sapiens
  misc_feature: GYAE6OF02HDNB6.26.67.G01.1.454.CMB.1.raw
  modified_base (240)..(240): a, c, t, g, unknown or other
  misc_feature (240)..(240): n is a, c, g, or t
  modified_base (422)..(422): a, c, t, g, unknown or other
  misc_feature (422)..(422): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagaccgaccccgtccggggatcccgtgagagattctctggcctccagttcagggacaagtggcctacttgactgtcaggtggggccagggtggaggatggaagctgactactactgttacncaacagacagtagtgtatcgagtgggtgttcggcggaggaccagctggaccgtcgtgggtcacgccgaaggcctcgccccgtcggtcacgtcctcgttccctaccc

SEQ ID NO: 147775 - DNA, 537 bp, Homo sapiens
  misc_feature: GYAE6OF02HDONK.26.67.G01.1.454.CMB.1.raw
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatatgcttattggtaccagcagaagtcaggccaggcccctgtgctggtcatctacgaggacagcacgaccgaccctcgggactcccgtgagagattctctggctccagttcaggacaagtcggacctaccttgactgtcgaggtcgggccgagggtggaggagtgaagcgtagactactacgttgttactacaacagacagtagtggttatcgagtggtgttcggcggacggacgaagcgtcgtaccgtcgtcggtcacgaccgacggctccgccccgtgtcctactcgtcgtccccg

SEQ ID NO: 147776 - DNA, 555 bp, Homo sapiens
  misc_feature: GYAE6OF02GKWK8.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggaccagcagaagtcaggccaggcccctgtgctggtcatctacgaggacagcagaccgaccccgtccgggatcccgtgagagtattctcgtggctccagttccgaggacaagtcggcctacttgactgtcgaggtcgggcccgagggtggaggagtggaagctagactacgtacttgtactacaacagactagtagtgttatcgtacgtgggtggttcggcggaggaccaggcgtagaccgtcgtcgggtacacggacccgacggccgtccggccccgtcggtcctacgttccgtccgttacccc

SEQ ID NO: 147777 - DNA, 818 bp, Homo sapiens
  misc_feature: GYAE6OF02G4WH5.26.67.G01.1.454.CMB.1.raw
  modified_base (242)..(242): a, c, t, g, unknown or other
  misc_feature (242)..(242): n is a, c, g, or t
  modified_base (339)..(339): a, c, t, g, unknown or other
  misc_feature (339)..(339): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattgaaccaaaaaatntgacttagttggtaccagcagaagtcaggccaggcccctgtgctggtcatctacgaggacagcagaccgacccgtcgggactcccgtgagagattcnctcggcctcagttcagggtacaagtcggacctacgttgaccttgtacgaggttcggggacccgtaggggtacgggaacgggtagttagggaaacggtccgttaacggtaaaccgttaaccgttaaccgtttacgggttttaaacccgtaccgtaaaaccgtaaacggtaaaccgtaacgggtttaaacgggtttacgggttttaaacgtttaccggtaaccgggttttacggggggttaccggggttttaccggggggtaaccgggggtaaaccgggggtaaacccggtaaacgggtaccgggttacccgggttaaccccgggtttacccgggttaccgggggttaacccgtaaccggggtaaccccccgggtaaaaccggggttccccggttaccccgggttaccccccccgggtttaccgggttaccccggttaaccccggtttccccggtttccccgggttttacccccccccggg

SEQ ID NO: 147778 - DNA, 640 bp, Homo sapiens
  misc_feature: GYAE6OF02I7018.26.67.G01.1.454.CMB.1.raw
  modified_base (240)..(240): a, c, t, g, unknown or other
  misc_feature (240)..(240): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttatggtaccagcagaagtcaaggccaggccccctgtgctggtcatctacgaggacagcagacgaccctccgggatccctgagagattctctggctccagttcagggacaagtggccactgactgtcaggtcggggcccaggtaggaggaggtagtaaggacgtacgtacgtaacctacgttacgtttacgtactaacgaacgacgtaacgtagggttaggttacgttacgtacgtacgggtttagggttacgggttacggggaacggggtaaccggaacgtaacggtcggtaccggtaccggtcgggtaccgggtaacggaccggtaaccggtaccggtaccggtcccccggtcccggtccggtacccgtaccgttccggttcccgtaccccccgg

SEQ ID NO: 147779 - DNA, 518 bp, Homo sapiens
  misc_feature: GYAE6OF02F110Z.26.67.G01.1.454.CMB.1.raw
  modified_base (506)..(506): a, c, t, g, unknown or other
  misc_feature (506)..(506): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaattgcttattggtaccagcagaagtcaggccaggcccctgtgctggtcatctacgaggacagcagacgaccctcgggatccctgagagattctctggctccagttcagggacaatggccacttgactgtcagtcggggccaggtggaggatgaagctgactactacttgttactcaacagacagtagttggttatcgtacgttgggtgttcgggcggagggacagcgtgaccgtcgtggtcacgcccgaaggctcgcccctcggtcncgtctcgtcccc

SEQ ID NO: 147780 - DNA, 531 bp, Homo sapiens
  misc_feature: GYAE6OF02IFFVI.26.67.G01.1.454.CMB.1.raw
  modified_base (333)..(333): a, c, t, g, unknown or other
  misc_feature (333)..(333): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaattgcttattggtaccagcagaagtcaggccaggcccctgtgctggtcatctacgaggacagcagacgaccctcgggatccctgagagattcnctggctcagttcagggacaagtcggccacgttgactgtcaggtcgggcccgagggtggaggagtggaaagcgtagactactacttagttactacaacagacagttagtgttatcgagtggtgttcggcggaggacgagctcgaccgtcgtggtccacgcccgtaaggccgtcgccccgtcgtccacgtcctcgtcccc

SEQ ID NO: 147781 - DNA, 583 bp, Homo sapiens
  misc_feature: GYAE6OF02HX4E4.26.67.G01.1.454.CMB.1.raw
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
tcagagactatactcacgaccggtgctcgatttagagtatacatattgggtttgggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaggccaggcccctgtgctggtcatctacgaggacngcagaccgaccctccgggactcccgtgagagtattctctcggcttccgagtttccgaagggacaagtcgggaccctaccgttgacttggtaccgagggtcggggcccagggtcgggaggagtgaagctgacctactacgttgttactcaacgagacaggttagttggttatcgtacgttgggttgttcgggcgggacggaaccgagctcggacccgtccggtgggtaccgacggcccgaaggtcctcggcccccgtcggtcccaccttccgtcgttaccccc

SEQ ID NO: 147782 - DNA, 630 bp, Homo sapiens
  misc_feature: GYAE6OF02IMZQG.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntagcttattggtaccagcagaagtcaggccaggcccctgtgctggtcatctacgaggacagcagaccgacccgtccgggatcccgtgacgagacttctctggtctccgagtttcgaagggtactaagtcgggaccctacgttagaccgttgtccgaggttcggggcccgtaagggtgggacggagtggaaaggtccgtagtaaccttacgttacttacgttacctacgaaacgtagaacgtaaggttaggttaggttactacggtaacgttggggttacgtttcgggacgggtaaggaccgagtccgttacgacccggtcgtcggtccgacgacccgtaacggtccgttccgccccggttcgtaccgtaccttccgtccgttccccgg

SEQ ID NO: 147783 - DNA, 534 bp, Homo sapiens
  misc_feature: GYAE6OF02GDI5M.26.67.G01.1.454.CMB.1.raw
  modified_base (240)..(240): a, c, t, g, unknown or other
  misc_feature (240)..(240): n is a, c, g, or t
  modified_base (331)..(331): a, c, t, g, unknown or other
  misc_feature (331)..(331): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggatccctgagagattcnctggctccgagttcgagggacaagtggacccaccttgactgtcaggtcggggccctagggtggaggatggaagctgactactactgttacacaacagacagtagtgttatcgacgtgggtgtcggcggaggacagcgtagccgtcgtcggtcacgccgtaaggcctccgccccgtcggtacctacgtccgtcgtccccgtccc

SEQ ID NO: 147784 - DNA, 508 bp, Homo sapiens
  misc_feature: GYAE6OF02HJMHN.26.67.G01.1.454.CMB.1.raw
  modified_base (242)..(242): a, c, t, g, unknown or other
  misc_feature (242)..(242): n is a, c, g, or t
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
  modified_base (473)..(473): a, c, t, g, unknown or other
  misc_feature (473)..(473): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggatccctgagagattctctggctcagttcagggacaagtggcctacttgactgtcagtcgggcccaggtggaggagtgaagctgactactactgttactacaanagacagtagtgttatcagtggtgtcggnggacggacagctgccgtcgtggtcngccgagcctcggcccctcggtcactctcgttcccc

SEQ ID NO: 147785 - DNA, 794 bp, Homo sapiens
  misc_feature: GYAE6OF02JV0GO.26.67.G01.1.454.CMB.1.raw
  modified_base (239)..(239): a, c, t, g, unknown or other
  misc_feature (239)..(239): n is a, c, g, or t
tcagagactatactcacgaccggtgctcgatttagagtatacatattgggtttgggggggctcaggaggcagagctctgggaatctcaccatggcctggaccctctcctgctccccctcctcactttctgcacagtctctgaggcctcctatgagctgacacagccaccctcggtgtcagtcgtccccaggacaaacggccaggatcacctgctccggagatgcattgaccaaaaaatntgacttatggtaccagcagaagtcgaggccacggcccctgtgctggcatctacggaggacagcagaccgaccctcgggtaactcccgtagaacggagtaacttcgtacgtcggtcccttaccgaggtttaccgaaggggactaaacggttcgggacccctaaccgtttgtaaccgttggtccgtaagggtccggggggtaccccgtaagggggttacgggaagggtaacggttacgggaaacggtccgttacgggtaacccttaacgttaacgttacggtttaaccgtaaccgtaaaccgtaaacggtacgtaaacggttaagggttaacgggtttacgtaaccgtaacggtttacgggggttacggtttaccggggaaccgggtaaccggggtaaacccgtaaacgggttccgttacccgggttacccggttcccggttaacgggggtacccgtaaccggtacccggtaaaccgggtccgtaccccgggttccccccgttacgggttccccgtaaccgtttccccgttacccggtttccccccgtaacccccgg

SEQ ID NO: 147786 - DNA, 540 bp, Homo sapiens
  misc_feature: GYAE6OF02HTPR8.26.67.G01.1.454.CMB.1.raw
  modified_base (241)..(241): a, c, t, g, unknown or other
  misc_feature (241)..(241): n is a, c, g, or t
  modified_base (334)..(334): a, c, t, g, unknown or other
  misc_feature (334)..(334): n is a, c, g, or t
  modified_base (387)..(387): a, c, t, g, unknown or other
  misc_feature (387)..(387): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacggaggacagcagacgacccgtcgggatccctgagagattcnctggctcctagttcagggacaatcggcctactttgactgtcaggtggggcccngggtggaggatggaagctagactactactgttactcaacgagactagtagttggttatcagtgggtgtcggcggagggacagcgtgaccgtcgtgggtcacggccaaggtcctcgcccccgtcggtcctaccgtccgtccgttccctaccccg

SEQ ID NO: 147787 - DNA, 564 bp, Homo sapiens
  misc_feature: GYAE6OF02F3WLQ.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattggtaccagcagaagtcaggccaggccccctgtgctggtcatctacgaggacagcagacgaccctccgggatccctgagagattctctggctccagttcaggacaatgccaccgttgactgtcaggtcggggcccagggtggaggagtagaagcgtgactactacttgttactcaacagacagttagtggttatacgtagtgggttcgttcgggcggtacgggaccgaaggcgtcgacccggttacgtcgggtcaccggcccgtaacggccgtcggcccccgttaccggtccgtaccttccgtccgttaccccccg

SEQ ID NO: 147788 - DNA, 601 bp, Homo sapiens
  misc_feature: GYAE6OF02F6YXP.26.67.G01.1.454.CMB.1.raw
  modified_base (240)..(240): a, c, t, g, unknown or other
  misc_feature (240)..(240): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatcgtacgaggacagcagaccgacccgtccgggatcccctgagagtattctcgtggctccaggttcagggacaagtcggacctacttgactgtcaggtcggggcccagggtggaggagtggaagcgtgactactactgttacacaacagactaggtagtaggttactcgacgttgggttggttcgggacgggtaacgggaccgaaggtcttacggacccgttcggtcgggtaccaccggtacccgaacggtcctacccggtcccccgttccgggttacctaccgtttccgttacccggtttaccccctacccccg

SEQ ID NO: 147789 - DNA, 609 bp, Homo sapiens
  misc_feature: GYAE6OF02H8JYK.26.67.G01.1.454.CMB.1.raw
  modified_base (245)..(245): a, c, t, g, unknown or other
  misc_feature (245)..(245): n is a, c, g, or t
  modified_base (521)..(521): a, c, t, g, unknown or other
  misc_feature (521)..(521): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattagaaccaaaaaaaatntgcttattggtaccagcagaagtcaggccaggcccctgtgctggtcatctagaggacagcagacgaccccgtccgggactcccgtgacgagtacttctcgtggcttccgaggttcgaagggaacaaagtcgggaccaccgtttgaacgttggtaccgtagggttcgggggacccctaggggtcgggaaggagttagaagcgtagtaacgttacttaacgtagtttaacctcaaacagacaggttagttagttaatcgtacggtgggtcgttcgggnggtacggaacacgctacggaccgttcgtgggtccacggtcccgaaggccgtcgccccgttcgggtcctacttccgtccgttacccccg

SEQ ID NO: 147790 - DNA, 588 bp, Homo sapiens
  misc_feature: GYAE6OF02JGFNM.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagaccgaccctccgggatcccgtgagagacttctctggctcagttcagggacaatggcctacttgactgtcaggtcgggccaggtggaggatggaagctgactactactgttactcaacagacagtagtggttatcgtacgttgggttcgttcgggcgggtacgggaccgaaggtccgtacggtacccggtccggttcggggtaccgaacggtaccccggaagggtcccgttaccgggccccccgttgggtaccctaccgttcccgttccggtttacccccccg

SEQ ID NO: 147791 - DNA, 521 bp, Homo sapiens
  misc_feature: GYAE6OF02F9CP7.26.67.G01.1.454.CMB.1.raw
  modified_base (240)..(240): a, c, t, g, unknown or other
  misc_feature (240)..(240): n is a, c, g, or t
  modified_base (454)..(454): a, c, t, g, unknown or other
  misc_feature (454)..(454): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgacccgtccgggatcccgtgagagattctctggctccagttcagggacaagtggccaccttgactgtcaggtcggggcccaggtggaggatgagctgactactactgttactcaacagacagtagtggttatcgagtgggtgttcgggnggagggacagctgacgtccgtggtcacgccgaaggctcgccccgtcggtccactctcgtccctcccg

SEQ ID NO: 147792 - DNA, 535 bp, Homo sapiens
  misc_feature: GYAE6OF02GG52J.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagacgaccctccgggatccctgagagattctctggcctccagttcagggacaatggccaccttgactgtcaggtgggcccagggtggaggagtgaagcgtagactactactgttactcaacagacagtagtgttatcacgtggtcgttcgggcggtagggaccaagctggaccgtccggtggtcacgcccgaaggcgtccggcccctcggtccacgtccttcgttcccccg

SEQ ID NO: 147793 - DNA, 535 bp, Homo sapiens
  misc_feature: GYAE6OF02FUQXU.26.67.G01.1.454.CMB.1.raw
  modified_base (240)..(240): a, c, t, g, unknown or other
  misc_feature (240)..(240): n is a, c, g, or t
  modified_base (416)..(416): a, c, t, g, unknown or other
  misc_feature (416)..(416): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctccgggatccctgagagattctctggctccagttcagggacaagtggcctacttgactgtcaggtcggggccaggtggaggagtgaagctgactactactgttacncaacagacagtagtgttatcgtacgtgggtgttcgggacgggaggacgaagcgtgaccgtcgtcgggtcacggcccgaaggcctccggccccgtcggtccacgtctccgtcccgtcccc

SEQ ID NO: 147794 - DNA, 668 bp, Homo sapiens
  misc_feature: GYAE6OF02GO13E.26.67.G01.1.454.CMB.1.raw
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcactgctccggagatgcattgaccaaaaaaatntgcttattggtaccagcagaagtcaggccaggcccctgtgctggtcatctacgaggacngcagacgaccccgtcgactccgagagagtctctcgtcgtcctacgtagtcgtagtacgaactagtccggtaccctacgtacgtacttcggtacgtacggggtccgggaccggtaggggtagggaaggtagtaagggacgtcgtacgtaaccgttaacgttacgttacgttacaacgtaacgacgtaacgttaaggttacggttacggtttataccgtaggtttcggggttcggtacgggtacgggtaacggtaaccgtaacggtcgtaccggtcccggtacgggttccggaaccggtacccgtaaccggtaaccggtcccgttccccggtaccccggttccgtaccgtacccgttccgttccccccgg

SEQ ID NO: 147795 - DNA, 532 bp, Homo sapiens
  misc_feature: GYAE6OF02H3DPU.26.67.G01.1.454.CMB.1.raw
  modified_base (241)..(241): a, c, t, g, unknown or other
  misc_feature (241)..(241): n is a, c, g, or t
  modified_base (417)..(417): a, c, t, g, unknown or other
  misc_feature (417)..(417): n is a, c, g, or t
tcagagactatactcacgaccggtgctcgatttagagtatacatattgggtttggggggactcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagaccgaccctccgggatcccctgagagattctctggcctccagttcagggacaagtggccacttgactgcaggtcggggcccagggtggaggagtagaagctgactactacgtnttacgtcaacagacagtagtgttatctagtgggtgttcggcggagggacaagcgtagccgtccgtggtcacgccgaaggcctcgccccgtcggtccacctctccgtccctacccg

SEQ ID NO: 147796 - DNA, 542 bp, Homo sapiens
  misc_feature: GYAE6OF02HK7PY.26.67.G01.1.454.CMB.1.raw
  modified_base (240)..(240): a, c, t, g, unknown or other
  misc_feature (240)..(240): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcagaagtcaggccaggcccctgtgctggtcatctacgaggacagcagaccgaccctcgggactccccgtgacgagtacttctcgtggcctcagttcagggtacaagtcggcctacgttgactgtcaggtcgggccaggtggagatgagctagactactactgttactacgaacagacgagtagttgtactcgacgttgggtcgtcggcggaaggaccgagtcgtcgaccgtctcgggcacggcccgtaaggcctccgccctacggcaccgtcttccgtcccgtccc

SEQ ID NO: 147797 - DNA, 516 bp, Homo sapiens
  misc_feature: GYAE6OF02IXHE9.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagacgaccctcgggactccctgagagattctctggctccagttcagggacaagtgccaccttgactgtcagtgggcccagggtggaggatggagcgtgactactactgttactcaacagacagtagtgttatcgacgtgggttgttcggcggaggaccagctgaccgtcgtggtcagaccaggctacgccccgtcggtccacgtctcgtcccc

SEQ ID NO: 147798 - DNA, 554 bp, Homo sapiens
  misc_feature: GYAE6OF02IOCHJ.26.67.G01.1.454.CMB.1.raw
  modified_base (240)..(240): a, c, t, g, unknown or other
  misc_feature (240)..(240): n is a, c, g, or t
tcagagactatactcacgaccggtgctcgatttagagtatacatattggggtttgggggggctcaggaggcagagctctgggaatctcaccatggcctggaccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagaccgaccctcgggactcccgtgagagattctctcggcctcgagttcgagggacaatcggccaaccttgactgtcgaggtcggggcccagggtggaggagtaggagctgactactactagttacacaacagactagtagtgttatctacggtgggtcgttcgggacggagggaccaagcgtagtaccgtcgtcgggtcacggacccgtaggccgtccgccccgtcggtccaccgtcgttccgtccctccccg

SEQ ID NO: 147799 - DNA, 546 bp, Homo sapiens
  misc_feature: GYAE6OF02G0QCS.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctccggagatgcattgaccaaaaaaatntgcttattggtaccagcagaagtcaggccaggccccctgtgctggtcatctacgaggacagcagaccgaccctccgggatcccctgagagattctctggctccagttcagggacaatggccaccttgactgtcaggtcggggcccagggtggaggatgaagctgactactacttgttactcaacagacagtagtggttatcgacgtgggtgttcgggcgggaggaccagcctggaccgtccgtgggtccacggcccgaaggtccgtccggcccccgtcggtccacgttccgtcgttacccccc

SEQ ID NO: 147800 - DNA, 588 bp, Homo sapiens
  misc_feature: GYAE6OF02HIOZ5.26.67.G01.1.454.CMB.1.raw
  modified_base (248)..(248): a, c, t, g, unknown or other
  misc_feature (248)..(248): n is a, c, g, or t
  modified_base (508)..(508): a, c, t, g, unknown or other
  misc_feature (508)..(508): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaaacggccaggatcacctgctccggagatgcattcgaaccaaaaaaatntagctttagttggtaccagcaagaagtcgaggccacggcccctgtgctggtcatcgtacgaggacagcagaccgacccgtccgggactcccgtagagagtacttcgtcgtggcctccgtagttcgaaggacaagtcggaccctacgttgactcgtcgagggtcgggcccgtagggtgggacggtagtaggaacgcgttagacttacgtacttcgttactacaacgagacagttagtgttatacgtcgttgggtgtcgggnggacggacgagctacgccgtcgtcggacacgacccgaaggtcctccgtccccgtcgtcctacgttccgtccgttcccccg

SEQ ID NO: 147801 - DNA, 625 bp, Homo sapiens
  misc_feature: GYAE6OF02H8OOE.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattagaaccaaaaaatntgcttattggtaccagcagaagtcaggccacggcccctgtgctggtcatctacgaggacagcagaccgaccctccgggactcccgtagagagattctcgtcggctccagttcgagggacaagtcggacctaccgttgacgtgtacgtaggtcggggcccgtagggtgggaggagtaggaagccgtagaactacttaacgttacgtttaacctacgaaacgtagaacgaaggttagttaggttactctacgttgggtcggtttacgggacgggtacggaaccgaaggccgtacggaccggttccggtgggtaccacggaccccgtaaggcccgtacccggtcccccgtacggtacccgtacgttacccgtcccggttcccccg

SEQ ID NO: 147802 - DNA, 547 bp, Homo sapiens
  misc_feature: GYAE6OF02HKN1N.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattgaaccaaaaaaatntgcttatggtaccagcagaagtcaggccaggcccctgtgctggtcatctacgaggacagcagaccgaccctccgggatccctgagagattctctggctccagttcagggacaagtcggccaccttgactgtcgagtcgggcccagggtggaggagtgaagctgactactacgttgttactcaacagacagtagttgttatcacgtgggtgtcggacggaggaccaagcgagtaccggtccgtgggtcacggtcccgaaggtcctacggtcccccgtcggtcccacgttccgtcggttcccccg

SEQ ID NO: 147803 - DNA, 627 bp, Homo sapiens
  misc_feature: GYAE6OF02IQC1B.26.67.G01.1.454.CMB.1.raw
  modified_base (246)..(246): a, c, t, g, unknown or other
  misc_feature (246)..(246): n is a, c, g, or t
  modified_base (468)..(468): a, c, t, g, unknown or other
  misc_feature (468)..(468): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattcgaaccaaaaaaaaatntagacttatggtaccagcagaagtcaggccacggcccctgtgctggtcatctacggaggacagcaggaccgacccgtccgggactcccgtgagagtattctcgtcggctccgtagttcgagggacaagtcgggaccctaccgttcgacttggtaccgagggtcggggcccaaggggtcgggaggagtggaagtcgtagtaaccgtacttacgttgttaaccncgtaaacagacgtagttaggtgttatacgagttgggtacgttcgggacgggacggaaccgtaggtccgtacggtaccgtcggtcgggtaccacggtacccgaacggtcccgtcccggtcccccggttcggacctaccgttcccggtccgttccccccgg

SEQ ID NO: 147804 - DNA, 563 bp, Homo sapiens
  misc_feature: GYAE6OF02I2TEO.26.67.G01.1.454.CMB.1.raw
  modified_base (248)..(248): a, c, t, g, unknown or other
  misc_feature (248)..(248): n is a, c, g, or t
  modified_base (395)..(395): a, c, t, g, unknown or other
  misc_feature (395)..(395): n is a, c, g, or t
  modified_base (482)..(482): a, c, t, g, unknown or other
  misc_feature (482)..(482): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattacgaaccaaaaaaaaaatntagtacttattggtaaccagcaagaagtcacggccacggcccctgtgctggtcatctacgaggacagcagaccgacccgtccgggactcccgtgagagtacttctctggctccgtagttcgaggacagtcggcctacttgactgtcnggtcgggaccgaggtaggacggtagagaagctagactactacttagttactacaacagactagtagtgttatctagttggtgtcggnggacggacgagtcgtacgcgtacgtgggtcacgaccgacgtccgtccgccccgtggtcctaccgttccgtccgttaccccg

SEQ ID NO: 147805 - DNA, 580 bp, Homo sapiens
  misc_feature: GYAE6OF02IDVEA.26.67.G01.1.454.CMB.1.raw
  modified_base (339)..(339): a, c, t, g, unknown or other
  misc_feature (339)..(339): n is a, c, g, or t
  modified_base (445)..(445): a, c, t, g, unknown or other
  misc_feature (445)..(445): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgagtcctcctatgagctgacacagccaccctcggtgtcagtgtccccaggacaaacggccaggatcacctgctccggagatgcattgaccaaaaaaattgcttattggtaccagcagaaagtcaggcacggcccctgtgctggtcatctacgaggacagcagaccgaccccgtccgggactcccgtgagagtattccncgtggctcagttcgaggacaagtcggcctactttgactgtcacgggtcggggaccgagggtcggaagggataggaagtctaggacctactagttgttactaccaanacgaacagtagttgttatacgacgtggggtgttacgggcggagggaccagcgtgaccggttcctgggtccacggcccaacgggtctcccggacccccgttcgggacctccgttccgttccggttccccgtccccg

SEQ ID NO: 147806 - DNA, 540 bp, Homo sapiens
  misc_feature: GYAE6OF02GY24N.26.67.G01.1.454.CMB.1.raw
  modified_base (239)..(239): a, c, t, g, unknown or other
  misc_feature (239)..(239): n is a, c, g, or t
  modified_base (420)..(420): a, c, t, g, unknown or other
  misc_feature (420)..(420): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgccaaaaaaatntgcttattggtaccagcagaagtcaggccaggccccctgtgctggtcatctacgaggacagcagacgaccctccgggatccctgagagattctctggctccagttcagggacaatggccacttgactgtcaggtggggcccagggtggaggatggaagctgactactactgttactcaacngacagtagtgttatcgacgtgggtgttcgggcggaggaccgaagctgaccgtcgtcggtcgacgcccgaacggccgtcgtcccccgttcggtcctaccgtccttccggtcccgtcccccg

SEQ ID NO: 147807 - DNA, 585 bp, Homo sapiens
  misc_feature: GYAE6OF02HY1VR.26.67.G01.1.454.CMB.1.raw
  modified_base (240)..(240): a, c, t, g, unknown or other
  misc_feature (240)..(240): n is a, c, g, or t
  modified_base (336)..(336): a, c, t, g, unknown or other
  misc_feature (336)..(336): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgaggacagcagaccgacccctcgggactcccgtgagagatttcncgtggcctccgagttcgagggacaagtcggccacttgactgtcaggtcgggcccagggtggaggatgaagctagactactacttgttactacaacagaacagtagtaggttatacgtacgttgggttgttccgggcggtaacggggaccaaggcgtacggaccgtccgtcgggtcgaccgcccgaaggtcccgtaccggtccccccgttcggtacccgtaccgttccgttcccgttaccccctaccccg

SEQ ID NO: 147808 - DNA, 785 bp, Homo sapiens
  misc_feature: GYAE6OF02HEJ31.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctcggagatgcattgaacctaaaaaatntgcttattggaccagcaagagtcaggccacggccctgtgctggtcatctacgaggacagcacgaccgacccgtcgggactcccgtggacgagtactttcgtacgtcggtccttaccgtaggtttaccggaaggggtaaccaaaggttccgggaccctaaccgttacggaccgttgggtaccggtacgggttaccgggggacccgtaggggttacggggaaagggtacgttagggaaacgtcgtacgtaacgttaacttaaccggttcgtttaacctaacgtaaaccgtaacggtaacgtaacgggttaacgggtttacggtttaacgttaccggtaacgggtttcggggtttacgggtttacccgggggaccggggtaaacgggtaacccgtaagggtaccgtaccgggttacccggtacccggttacggggtaacccgtaaccgggtaaccccggtaacgggttccccgttccccgggttaccccccggttacgggttaccccgtaacccgtttcccggtttaccccggtttaacccccccg

SEQ ID NO: 147809 - DNA, 564 bp, Homo sapiens
  misc_feature: GYAE6OF02GDPPD.26.67.G01.1.454.CMB.1.raw
  modified_base (240)..(240): a, c, t, g, unknown or other
  misc_feature (240)..(240): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagagactatactcacgaccggtgctcgatttagagtatacatattgggtttggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttatggtaccagcagaagtcaggccaggcccctgtgctggtcatctacgaggacagcagaccgaccctccgggactcccgngagagattcncgtggctccgagttcagggacaagtcggacctacttgacctgtcgaggtcggggcccagggtggaggagtgaagctagactactactgttactacaacagacagtagtgttagtctacgtgggtcgttcgggcgggtacggaccaaggcgtcggaccgtcgtcgggtcaacgcccgaaggtccgtaccgcccccgtcggtccaccgttccgttccgttacccctaccccg

SEQ ID NO: 147810 - DNA, 568 bp, Homo sapiens
  misc_feature: GYAE6OF02G9120.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgctggtcatctacgagacagcagacgacctcgggatccctgagagattctcgtggctccagttcagggacaagtcggcctacttgactgtcgaggtcggggccctaggggtggggagtaggtaggacgtcgtacgtactacgtacgttacgtactaacaacgacgacgtagttgttagttactacgtcgggtggttcggtacgggtacggacgaacgtagtcgtacgtccgtggtcggcgaccgacgacgtccgtacccgtccgtcgtcctcgtccgtcccgtcccg

SEQ ID NO: 147811 - DNA, 719 bp, Homo sapiens
  misc_feature: GYAE6OF02IARSA.26.67.G01.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctccgganagtgcattgaaccaaaaaaatntancttaattggtaccagcagtaagtcacggccacggcccctgtggctggtccatctacgaggacagcagtacacccgtccgggactcccgtgagcgaattctctgctccgtagttaccgaggtaacaaaggtcggtaccctaacgttcgaacgttcgtacgagggtaccggggcccgtaaggggtacggggaaggtaacgttaggaaacggtcgtacggtaaccgttaacccgttaacttacgggtttaaaccttaccgaaaaccgtaaacggtaacgtaaacggttaagggttacgggttttaaactaccggtaccgggtttagggttcggtttacggggaccgggggtaaacgggtaacccggaaggtaccgttcggtaaccgttcccgggaggttaccgacggtacccgtaacggtccgtacccggtcccccgtcggttaccctacccgtccgttacccgttaacccccg

SEQ ID NO: 147812 - DNA, 717 bp, Homo sapiens
  misc_feature: GYAE6OF02HONL7.26.67.G01.1.454.CMB.1.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (278)..(278): a, c, t, g, unknown or other
  misc_feature (278)..(278): n is a, c, g, or t
tcagagactatactcacgaccggtgctcgatttagagtatacatattggttttgggggggctcaggaggcagagctctgggaatctcaccatggcctggaccctctcctgctcccctcctcactttctgcacagtctctgaggcctcctatgagctgacacagccaccctcggtgtcagtcgtccccaggacaaacggccaggatcacctgctccgganatgcattgaaccaaaaaatntgcttatggtaccagcagaagtcaggccaggcccctagngctggtcatctacgaggacagcacgaccgacctcgggactcccgtaggacgaggtacttacgtcgtacggtccttaccgtaggttccgaaggggtaacctaaagtccgggtaccctacgtttagaacgttcggtacgtacggggtccggggacccgaaggggttacgggaacggtacgtaggtaaacggtcgttacgtaaccgtaaccgttaagttacggttaacctacgaaacgtacgtaacgtacggttacggttaggtttacctacgtacggttcgggttacggttaccgggacggggtaacgggtaacctaaggtccgttacgggttaccccgttacggttacgggtaccgaaccgggtacccgaagggtcccgttaccggtcccccggttacggtaccgtacccgtttcccgttcccggttacccccgtacccg

SEQ ID NO: 147813 - DNA, 662 bp, Homo sapiens
  misc_feature: GYAE6OF02HUWWI.26.67.G01.1.454.CMB.1.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctgctccggagatgcattacaaccaaaaaaatntagcttaagttaggtaccagacaagaagtcaaggccaggcccctgtgctggtcatctaggagacagcagaccgaccctcgggactcctaganagtattctcgtcggctcctaggttaccgagggtaacaagtcggaaccctacccgttaggacttacgtcgaggttcgggggaccctaggggttacgggaaggtagtacggaaaggtaccgtaagtaacgttaacctacgggttacttacctaacaaacgtagaactacggttagtacgggtttaatcgtacgttgggttcggttaccgggacgggaacggtaaccgtaagccgttcgggaacccggtccggtagggaaccctaggacccgtaacggtcgtcccgtcccggtaccgtaccctacgttccgttacccgttcccccgg

SEQ ID NO: 147814 - DNA, 602 bp, Homo sapiens
  misc_feature: GYAE6OF02IC1FK.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattggggtttggggggggctcaggaggcagagctctgggaatctcaccatggcctggacccctctcctgctcccccctcctcactttctgcacagtctctgaggcctcctatgagctgacacagcccaccctcggtgtcagtgtccccaggacaaacggccaggatcacctgctcggagatgcattgaccaaaaaaatntgacttattggtaaccagcagaagtcaggccaggcccctgtgctggtcatctacgaggacagcagaccgacccgtccgggactcccgtgagagattctctggctccagttcgaggacaagtcgcctacttgactgtcaggtcggggcccgagggtggagggtagtaggaacgcgtacgaacttacgttaacgtgttaactacaaacagtaactaggtaggttggttaatcgtacgttgggtggttcgggacgggtaacgggaccaaaggcctacggaccgttaccgtggggtacaacggcccgtaaggcccgtccgtccccgttcggtaccaccgtccgttaccggtcccccgtccccg

SEQ ID NO: 147815 - DNA, 555 bp, Homo sapiens
  misc_feature: GYAE6OF02GREYO.26.67.G01.1.454.CMB.1.raw
  modified_base (429)..(429): a, c, t, g, unknown or other
  misc_feature (429)..(429): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatatgcttattggtaccagcagaagtcaggccaggcccctgtgctggtcatctacgaggacagcagaccgacccgtccgggatccccgtgagagattctcgtggcctccagttcgagggacaagtcggcctaccgttgactgtcaggtcggggcccgagggtggaggatggaagctagactactactgttacncaacagacgagtagtggttactcgtacgtgggtgttcgggcggacgggacaagctggccgtcgtgggtcgaccgccgaagccgtccgccccgtcggtcctaccgttccgtccgttccccgtccccg

SEQ ID NO: 147816 - DNA, 523 bp, Homo sapiens
  misc_feature: GYAE6OF02F8Z0L.26.67.G01.1.454.CMB.1.raw
  modified_base (243)..(243): a, c, t, g, unknown or other
  misc_feature (243)..(243): n is a, c, g, or t
  modified_base (469)..(469): a, c, t, g, unknown or other
  misc_feature (469)..(469): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcattgaccaaaaaaatntgcttattggtaccagcagaagtcaggccaggcccctgtgctggtcatctacgaggacagcagaccgaccctccgggatccctgagagattctctggcctccagttcagggacaagtggcctaccgttgactggtcaggtcggggcccgtagggtgggaggagtggaagtcgtagactactacttgttactacaacagacagtagtgttatcacgtggtgttcggnggaggacagctgccgtcgtgggcncgccgagctcgccctgccnctctcgtcccc

SEQ ID NO: 147817 - DNA, 804 bp, Homo sapiens
  misc_feature: GYAE6OF02J0BE7.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctcccctcctcactttctgcacagtctctgaggcctcctatgagctgacacagccaccctcggtgtcagtcgtcccaggacaaacggccaggactcacctgctccggagatgcattgaaccaaaaaatntgacttattacggtaccagctagaacgtcgacggccacggccctagtcgcgtggtcatcgtaacgaggaccagcagaccgacccgtacgggactcccgtgacgacgtagttccgtacgtcgggtaccttaccgtacgtttaccggaagggaacctaaacggttccggggacccctaaacccgggttttccggaaccgttacgggtaccggtaacggggttaccgggggtacccccgtaaggggggttaccggggttaagggaacgttacgggaaaacggttcccgtaaggtaaccgttaaccgttacgttacggtttaaccctacggaaacctaacgtaaccggtaggtttaagggttcgttaacgttaccggtaaggttcggggtttcggggttaacccgggtagggggtaacgggtaacccgtaacgggtaccgttaccgggaaccccgtttttcgggggaaccgggtaccggttacggaaccccggtaacggtttcccggtacccggttcccccgtaacggggttccctaccggttcccggttacccgttaccccccgg

SEQ ID NO: 147818 - DNA, 659 bp, Homo sapiens
  misc_feature: GYAE6OF02IEMK3.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctccggagatgactattagaaccaaaaaaaaatntacgacttattaggtaccagacaagaagtcaggccgacggcccctgtcgcgtggtcagtcgtacggagacgacgcgaacggaccgtacccgtaccgggactcccgtagagagtacttcgtcgtggctaccgtagttcgaagggtacaagtcgacctacgttcgacgtgtacgacggtccggggacccaagggtcgggaaggtagtagaagtcgtacgtaactacgtacgttcgttactacgaacgagacgtagtagttagttactcgtacggttggttacggttcggacggacgggtaaccgaagtccgtacggacccggttcggtacggggttaccaaccggtacccgaacggtcccgtcccgttaccccggttcgtaccgttacccgttcccgttaccgttaccccccgg

SEQ ID NO: 147819 - DNA, 636 bp, Homo sapiens
  misc_feature: GYAE6OF02HXX9P.26.67.G01.1.454.CMB.1.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (287)..(287): a, c, t, g, unknown or other
  misc_feature (287)..(287): n is a, c, g, or t
  modified_base (456)..(456): a, c, t, g, unknown or other
  misc_feature (456)..(456): n is a, c, g, or t
  modified_base (518)..(518): a, c, t, g, unknown or other
  misc_feature (518)..(518): n is a, c, g, or t
tcagagactatactcacgaccggtgctcgatttagagtatacatattgggtttgggggtgggcgtcaggaggcagagctctgggaatctcaccatggcctggacccctctcctgctcccctcctcactttctgcacagtctctgaggcctcctatgagctgacacagcccacctcggtgtcagtcggtccccaggacaaacggccaggatcacctgctccgganatgcagtanaaccaaaaaatntgcttaattggaccaagcaagaagtcaaggccacggccctgnctggtcatcacgagacagctacgacgccctacggactcccgtaggagtacggaatttccgacgtcgggtactaccccgtaggtttccgaaaggggaacctaaaagttcggaaccctaacgtttcgaacgtgtacccgtaaggtcggggccccaggggttagggaacggngtaagaaagcgttacgacttaacacgttacggtttacacaacgatacaagtcgtaggttacntacgtgggttcgtacgggtcggacggaaccgagtcgtacggtaccgtcggtcgggttaccaggtacccgaaggtccgtaccgccccggtacggtccgtacttccgcggtttacccccg

SEQ ID NO: 147820 - DNA, 634 bp, Homo sapiens
  misc_feature: GYAE6OF02JG7NP.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctccggagatgcattcgaccaaaaaaatntgacttattggtaccagcaagaagtcaggccacggccccctgtcgctggtcatcgtacgaggacagcagaccgaccctcgggatccctggagagattcgtcgtcgctccagttccgagggactaagtcggccacgttgactgtcgaggtcggggccgtaggtgggaggaagtggaagcgtgaccgttactacgtagttacacaaacagacgtaggtagttaggttactacgtacgtgggttggttccgggacgggtaacgggaccaaggccgttacggtacccgttcgggtacgggttcggaaccgtacccggtaacggtcccggtaccggtcccccggttacggtaccctaacccggttccgtttacccggttaccccccttaccccgg

SEQ ID NO: 147821 - DNA, 591 bp, Homo sapiens
  misc_feature: GYAE6OF02GYX7P.26.67.G01.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (412)..(412): a, c, t, g, unknown or other
  misc_feature (412)..(412): n is a, c, g, or t
  modified_base (440)..(440): a, c, t, g, unknown or other
  misc_feature (440)..(440): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccgganatgcattgaccaaaaaaatntgacttattggtaccagcagaagtcaggccaggcccctgtgctggtcatctacgaggacagcagaccgacccctcggggactccccgtggacgagacttctctggcctccagttcgagggacaagcggcctaccttgactgtcaaggtcgggccagggtggaggatgaacgngtagactacgtacttgttactcaacganacgagtagtaggttatactacgtgggttcggttacgggcgggtacggaccgtaagccgtacgtacccgtcgtacgggtccaccggacccgtaaggacctccggtacccccgttcggtcccgacccgtttccgtcccgttccccgtaccccg

SEQ ID NO: 147822 - DNA, 686 bp, Homo sapiens
  misc_feature: GYAE6OF02FF8DO.26.67.G01.1.454.CMB.1.raw
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagagactatactcacgaccggtgctcgatttagagtatacatattgggtttggggggggctcaggaggcagagctctgggaatctcaccatggcctggacccctctcctgctcccctcctcactttctgcacagtctctgaggcctcctatgagctgacacagccaccctcggtgtcagtgtccccgaggacaaacggccaggatcacctgctccgganatgcattcgaccaaaaaaatntagcttattggtacagctagaagtcacggaccacggcccctggtcgctcggtcatctacgagtacagcacgaccgacccgtccggactcccgtgaggtacgtacttacgtctcggtcctccgtagttccgagggtaccaagtcggaccctaccgttcgacctcggtaccgtacgggtaccggggtacccgtaggggtacgggtagggtacgttacggaacgtcgtacggtaactaaccgttacgttacgttaacgtactaacgacgtaacgtaggttacggttagtttacgacgttacggttacggggttgtttacggggaccgggtaacggtaaaccgtagggtaccgtcggtacccggtcggtacgggtaccaccggacccgtacggtccgtccggaccccgttcggtacccgtccgttcccgttccgttccccgtcccccg

SEQ ID NO: 147823 - DNA, 660 bp, Homo sapiens
  misc_feature: GYAE6OF02IK6G7.26.67.G01.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtcccgaggaccaaacggccaggactcacctgctccggagntgctattacgaaccaaaaaaatntagtcttattacggtaccagacagaagtcgacggccgacggcccctggtcgcgttcggtcatccgtaacggaggacagcgacgaccgacccgtccggactccgtaggagtagtcttcgtcgtcggtcctcgtacgttcgaggtacacgtcgacctaccgttgactgtcgtacgggtcgggaccgtagggtggaggagtaggaacgcgtacgtacctacgttacgttacgtactacgaacgtacgtacgtaggttgttaggttactacggtacggttgggttcggtcgggacgggtaacggacgtacgtccggtaccgtaccggtaccggtcgggtaccaccggtaacccgacggtccgtccccggtccccgttacggtcccctaccggttcccgttacccgttacccccg

SEQ ID NO: 147824 - DNA, 723 bp, Homo sapiens
  misc_feature: GYAE6OF02GQPMB.26.67.G01.1.454.CMB.1.raw
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctgctccggagatgcattagaaccaaaaaaaaatntagactttattaggtaccagacaagaagtcgacggccgacggcccctgtcgcgtggtcatcgtaacggaggacaggcgaacgaccgacccgtccgggactcccgagagagtacttcncgtcggtcctcgtacgttcggaagggtaactaaggtcggtacccttaaccgttagaccgttacggtacgtaggggtccggggacccgtaggggtacgggaggtaacgtaggtaacggtcgtacgtaaccttaccgttacgttacgttaccgaaccgaacgtagtaactaaggttacggttagttacgttaccgtaagggttcggggttacggttcggggtacggggtaaccgaacggtaccgtccgtacggtacccgttcgggtccgggtaaccgaccggtacccggtaacggtcccgttccccggtcccccggttaccggtacccgttacccgtttcccgttaccccgttccccccgg

SEQ ID NO: 147825 - DNA, 710 bp, Homo sapiens
  misc_feature: GYAE6OF02JA1CY.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgcctccggagatgcattgaaccaaaaaaaatntgacttatggtaccagacagaagtcgaggccacggcccctggtgactggtccatctacggaggacagcagaccgaccccgtcgggactcccgtgacggtacgtacttcctcgtacggtcctaccgtacgttccgacgggaacctaaggtcggtaccctaccgttacgacgttcggtacgtaaccgggttcgggggaccccgtaaggggtcgggtaagggtaacgttaggaaacgggtacgtacgggaaccgttaacgtaccgttacggtttaccgtaacgaacgtaacgtaacgtacggtaagtttacggttactaccgtaacggttgggtcggttacgggacggggacggtaaccgtagtcggtaccggtaaccgtccggtacgggtacaccggtacccggaacggtcccgacccggttccccggttaccggtccgtacccgttccgtacccgttccccccg

SEQ ID NO: 147826 - DNA, 682 bp, Homo sapiens
  misc_feature: GYAE6OF02I9YEJ.26.67.G01.1.454.CMB.1.raw
  modified_base (246)..(246): a, c, t, g, unknown or other
  misc_feature (246)..(246): n is a, c, g, or t
  modified_base (339)..(339): a, c, t, g, unknown or other
  misc_feature (339)..(339): n is a, c, g, or t
  modified_base (461)..(461): a, c, t, g, unknown or other
  misc_feature (461)..(461): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgctattgaccaaaaaaaaatntagcttattggtaccagcagaagtcaggccacggcccctgtgctggtcatcgtacgaggacagcagaccgcccgtcgggactccctgagagtnttctcgtggctccagtcgagggacagtcggcctacttgactcgtcgagggtcggggccgtagggtacgggaggtagtggaaacggtcgtacggaaccttacgttaaccgttcggtttaaccncgtaaaccgacgtaacgtaagggttacggttaggtttaacgtaccgtacggtttacggggttaggttccggggtacgggaacggggtaaccaagggtcccgtacgggtcccgttaccgggttcggggttaaccgacggtaccccggtaacgggtccccttacccgggtcccccggtttcccgggtaccgtacccgttcccggttacccgtttaccccccgg

SEQ ID NO: 147827 - DNA, 663 bp, Homo sapiens
  misc_feature: GYAE6OF02JT92P.26.67.G01.1.454.CMB.1.raw
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
tcagagactatactcacgaccggtgctcgatttagagtatacatattgggtttgggggtggggcgtcgaggaggcagagctctgggaatctcaccatggcctggacccctcgtcctgcctcccctcctcacttctgcacagtctctgaggcctctatgagctgacacagccacccgtcggtcgtcgagtcgtccccgaggacctaaacggcctaaggactcacctgctcggagatgcatcgacaaaaatntcgcttatgactagngacgaagtcaggaccaacggccctacggtgccgtaggtcacgtaccgtacgaaggaccaaggcgacgaccggtacccctaccgggacttacccgagaccgtaggtaccttcgacgttcggccgttccaggtttacgagggtaccaagtccggacttacccgttgactggtacagggttcggaccgtagggtggaacgggatggaacgtcgngtaactacgttacacgtttacactaagacgacgtagngtttaacggtnttacggtacgttagggtcgggttacgcgggtaacggacggtacgacggtcgtaacggtccggttacgggtaaccgacggtacccggtaccggacgtcccggtacccggtcgttacccgacgtcccggttacgttccccg

SEQ ID NO: 147828 - DNA, 607 bp, Homo sapiens
  misc_feature: GYAE6OF02H9NDV.26.67.G01.1.454.CMB.1.raw
tcagagactatactcacgaccggtgctcgatttagagtatacatattgggtttgggggtggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaaggactcacctgctccggagatgcattcgaaccaaaaaaattgcttagttcggtaccagcaagaagtcgaggccgaggcccctgtcgcgtggtcatctacggaggacagcacgaccgaccccgtcgggactccctaggacgagacttcgcgtacggctccgagttcgaagggacaacgtcggaccctaacgttgactggttacgacgggtcgggacccgtagggtcgggaggtagtaggagtctacgactacgtacgttacgttactacaacgagacgtagtagttagttatcgacgttggtcggttcggcggaggacgagtcgacgtacgtcggtcggtacacggcccgtaacgtccgtaccgtccccgtcggtaccctacgtccgttaccgttcccccg

SEQ ID NO: 147829 - DNA, 771 bp, Homo sapiens
  misc_feature: GYAE6OF02HL4CH.26.67.G01.1.454.CMB.1.raw
  modified_base (277)..(277): a, c, t, g, unknown or other
  misc_feature (277)..(277): n is a, c, g, or t
tcagagactatactcacgaccggtgctcgatttagagtatacatattgggtttgggggtgggctcaggaggcagagctctgggaatctcaccatggcctggacccctctcctgcctccccctcctctactttctgcacagtctctgaggcctcctatgagctgacacacgccacccgtcggtgtcacgtccgtaccccgaaggaaccgaaaaccggccaaggactaccaccgtgccgtaccggagactcgactaagttacgaaaacctaaaaaattntacgtactttagtacgtacgacgagaagtaacgacgacggccgaccggtcccgtggtacgtcgtcggtacacgtaccgtaaggacggaacacggtacgaaccggaccccggacccgtaccgggaccttacccgtagaaggtactacttcgtcgttcggacctcctacggtaccgaaggaactacgtccggaccttaacgttcgaccgttagggtacgtacggggtcgggacccggtaggggtagggacggtagtacggaaacgtcgtagtaaccgtttactaccgtttaacgtactaaccgaaaccgtagtaacgtacggttaggttaacgttacgtacggtagggttacggggtacgttacggggaccggtaacggtaaccgacggttcgaccggttaccgtccgggtacggtaccaccggtaaccggaccggtttccggaccccggtttccccgtacgtacccgtaccgtttacccttaccccggtaacccc

SEQ ID NO: 147830 - DNA, 599 bp, Homo sapiens
  misc_feature: GYAE6OF02FPW00.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaaatntgcttattggtaccagcaagaagtcaggccaggcccctgtgctggtcatctacgaggacagcagaccgacccgtccgggactcccgtgagagtacttcgtctggcctcagttcgagggacagtcggcctacttgactgtcgaggtcggggcccagggtgggaggagtaggaagcgtagactaacgtacgttgttaactcaaacgagactaggttaagttggttactacgtacgtttggggtgttccgggacgggacgggaccaagtccgtaggacccgtccgtaggggtccaaccggacccgtaacggcctaccggcccccgttacggtccgtcctccgttccgttccccctaccccg

SEQ ID NO: 147831 - DNA, 754 bp, Homo sapiens
  misc_feature: GYAE6OF02JD7KF.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgcgtccggagatgcattagaaaccaaaaaaaatntgactttagttggtaccagacaagaagtcgacggaccgacgggtcccccttggtcgtcgtcgggtacctacgttaccgtaacggaacggaaccacggaccgaacggtaaccccggacccccgttaccggggaaccttcccgtacggaacggaacgtactttccgtcgttcgggtacccttaccgtacggtttacggaaacgggtaacaacggttcgggaccctaccgtttcgaccgtcggttacgacggggtcggggaccctaggggtagggaggtagtacggtaagccgtgtaactaccgttattaccgttactaccgtaacgacgtaacgtaaggttaggttacggttactcgtacgggtttcgggtacgggttaccggggtacgggaacggtaacggaacgtccggtaccggttaccggtccggtagggtaccgtacggacccggtaacggtcccgtaccggtcccccgttcgggtacctccgtttacggtccccgtcccccgg

SEQ ID NO: 147832 - DNA, 600 bp, Homo sapiens
  misc_feature: GYAE6OF02G936B.26.67.G01.1.454.CMB.1.raw
  modified_base (243)..(243): a, c, t, g, unknown or other
  misc_feature (243)..(243): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattgaaccaaaaaaatntagcttagttggtaccagcaagaagtcgaggccacggccccctgtgctggtcatctacgagacngcagaccgacccgtcgggactccctgagagtnttctctcggctcagttcgaggacaagtcgcccacttgactgtacgacggtcgggcccgtagggtcggaaggtagtggaagcgtacgtaaccttacctacttagtttacacctaacgacgagaggttagtaggttactcgtacggttgggttcggttcgggacgggagggaaccaggtcgtacggtccggtccggtcgggtaccacggtccgacggtcccgtccggccccggttcgtacctccttccgttcccgttcccccg

SEQ ID NO: 147833 - DNA, 688 bp, Homo sapiens
  misc_feature: GYAE6OF02IMTIH.26.67.G01.1.454.CMB.1.raw
  modified_base (249)..(249): a, c, t, g, unknown or other
  misc_feature (249)..(249): n is a, c, g, or t
tcagagactatactcacgaccggtgctcgatttagagtatacatattggggtttggggggggctcaggaggcagagctctgggaatctcaccatggcctggacccctctcctgctcccccctcctcactttctgcacagtctctgaggcctcctatgagctgacacagccaccctcggtgtcagtcgtccccaggacaaacggccaggatcacctgctccggagatgcattagaaaccaaaaaaaaatntagacttaagttggtaaccagcaagaagtcaggccacggcccctgtgctggtcatcgtacgaggacagcagaccgcccgtccgggactcccgtaggacgagtattctcgtcggcttaccgtagttcgaagggtactaaggtcggaccctaccgttgaccgttggtaccgacgggttccggggacccgtaaggggtcgggaagggtaatagggaaacgtcgtaggtaaccttaacgttacgtttacggtttaacctaacgaacgaacgtaacgtaaggttaggttaggttaactcgtacgggttggggttacggttacgggacgggtaacgggtaaccgaacggtcgtacggaccggttccggtgggtaccaccggtaccgaacggtcccgccggtcccccgtacggtcctaccgttccgttccggttcccccgtacccg

SEQ ID NO: 147834 - DNA, 628 bp, Homo sapiens
  misc_feature: GYAE6OF02IN5HH.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctgctccggagatgcattagaaccaaaaaaatntgcttattggtaccagacagaagtcaggccacggcccctgtcgctggtcatctacggaggacagcagaccgacccgtccgggactcccgtagagagtacttctctggctccgacgttcgagggacaagtcggaccctacgttgacgtgtcgagggtcggggcccgtagggtgggaggtagtaggaagcgtagaaccttacgtacgttacgttacacaaacacgtaactaggttagtcggttaactcgtacgttggggtacgtttcgggacggggacggaaccgagtccgtacggtacccggttccggtcggggtaccacgggtacccgaacggtccgtcccggtccccgttcggtaccctaccgttccgttccgttacccccg

SEQ ID NO: 147835 - DNA, 604 bp, Homo sapiens
  misc_feature: GYAE6OF02F8RV4.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaaaatntagacttattggtaccagcagaagtcaggccagggcccctgtgctggtcattctacggaggacagcagaccgaccctccgggactccctgagagattctcgtggcctcagttcagggacaagtcggcctaccgttgactgtcaggtcgggccgtagggcggaggacgtaggaacgcgtagtactacgttacgttagttactacgaacgacgacgtaggttagttggttaattacgacggttgggtacggttcgggacggtagggaccgaagtccgtaggtacccgtcggtcgggtacgacggacccgaacggtccgtccgtcccccggttcggtccgtaccgttcgtcccgtttcccccg

SEQ ID NO: 147836 - DNA, 708 bp, Homo sapiens
  misc_feature: GYAE6OF02IKXKZ.26.67.G01.1.454.CMB.1.raw
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccacccgtcggtgtcgagtcgtaccccaggaacgaaaccggccaggatccactgctccgganatgctattacgaaacctaaaaaaatntgtactttagttacgtaccagacgaagaacgtcgagccgacgccccgtgtcgcgtggtcagtctacggaggacagcgaacgaccgacccgtcggactccagagacgtattcgtcgtcgactcgtacgttgacggaacagtcgacctacttgacgtcgtacgaggtcggaccgtaggtcggaagagaggaaagccgtacgtaacttacgtacgttacgtttaactaaccgaaacgacgtaccgtaaaggttagggtttaacgttaacttcggtacggtttcggggttacggttaccggggtaacgggaccgggtaaaccgtaacggccgttacccggtaccgggttacccggttacgggtacccggaaccgacccggtaacggtccccgtacccggttcccccgttacgggttaccccgtaccgtttccccggttaccgttaccccccccgg

SEQ ID NO: 147837 - DNA, 762 bp, Homo sapiens
  misc_feature: GYAE6OF02HIG0R.26.67.G01.1.454.CMB.1.raw
  modified_base (254)..(254): a, c, t, g, unknown or other
  misc_feature (254)..(254): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtcgtccccaggaacaaacgaccaggactcacctgccgtccggagactgactaattacgaaaccaaaaaaattnttacgtacttttaagttacggtaacccaaggaccgaaaggtaacgttaccgacgggacccctacgggtcccccgttggtcgtcgttacggtaccagtaccgtaacggaaggacagacgaacggacccggtaccccgtccgggtaccttcccgtaggacgacgttacttccgtcgtcggtccttaccgtaggttaccgaacgggaactaacggtcgacccttaccgtacgtacgtcggtaccgggacgggttccggggacccgtagggtacgggaaggtagtacggacgtacgtagtaccttacgtacgttacgtaacgtacgaacgtaagacgtaggttacggtagttacgtaccggttagggtcgggttacgggtacgggtacgggaacggaaccgtaaggtccgttaccggtccggtcggttaccgggacggaccggtaacccgtacggtcccgtcccggtccccgttacggtcccttccgttcccgttcccgttccccgtacccg

SEQ ID NO: 147838 - DNA, 699 bp, Homo sapiens
  misc_feature: GYAE6OF02HKVPG.26.67.G01.1.454.CMB.1.raw
  modified_base (246)..(246): a, c, t, g, unknown or other
  misc_feature (246)..(246): n is a, c, g, or t
  modified_base (355)..(355): a, c, t, g, unknown or other
  misc_feature (355)..(355): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctgctccgggagatgcattagaaccaaaaaatntgcttattggtaccagcaagaagtcacggccacggcccctgtcgctggtacatcgtacgaacggacacgcacgtaccgacccgtccgggatcccgtagacgagacttcncgttcgactcagttcgaagggacaagtcggacctacgttgaccttgcgtacggtcgggacccgagggtacggaggtagtggaaacgtctacggtaccttaacgtacgttacgtttaaccgaaccaacgtaacgaaccgtaggtttaacgggttacgtttaacgtaccgtaacgggttcggggtttaccggttagggtaaccgggggtaacgggtacccgtaaaggttccggtaccgggtaacccgttccgggtacggggttaccaaccggacccgtaaccggccgttaccccggtacccccgttaggtaccccgttaacgttcccggttacccttaccccccgg

SEQ ID NO: 147839 - DNA, 632 bp, Homo sapiens
  misc_feature: GYAE6OF02ISPHL.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaaaatntgacttatggtaccagcaagaagtcaggccaggcccctgtgctggtcatctacgaggacagcagacgaccctcgggactccctgacgagattctgtcgctccagttcgagggacaagtcgggaccctaccgtttgaccttggtcgtagggtcggggccccgagggtacggagggataggaagtcgtagtaactaccgtacgttagttacctacaacgaagtacgtaggtagttaggttataccgtagttggggttcggttcgggacgggtacgggaaccgaaggtaccgtcggtacccggttccgtacggggtaccgtaccggacccggtaacggccgttcccggccccgttcggtcctacccgtccgtttacccgttcccccgtccccg

SEQ ID NO: 147840 - DNA, 717 bp, Homo sapiens
  misc_feature: GYAE6OF02G6TY0.26.67.G01.1.454.CMB.1.raw
tcagagactatactcacgaccggtgctcgatttagagtatacatattgggtttgggggggctcaggaggcagagctctgggaatctcaccatggcctggaccctctcctgctcccctcctcactttctgcacagtctctgaggcctcctatgagctgacacagccaccctcggtgtcagtcgtccccaggacaaaccggccaggatccacctgacgtccggagatcgacattacgaaacctaaaaaaatctgtactttagttacgggtaaccagactaagaagtcacggccacggcccctgtcgaccgtggttccacgttacgacggacggaacacgacgaacgacccggtacccgtccggggtaacctcccgtaggacgagtacttcgtcgtcggccttcgacgttcggaacggtacacgcggtacctaccgtgaccgttgtacggtagggtccgggcccggtagggtacgggagggtaataggaaacgtcgtacgtaaaccgttacgttaccttacggttaactaccgaaactacggtaacgtaacggtttaggttacggtttacgtacgtacgggtttcggggtttaccggttcgggaacgggtaacgggtaaacgtaacggtccgtacggtacccgtacgggtcggtacggaccgccgaacggtcccgccgtaccccggtcgtccgttaccggctttccccgcccttaccccg

SEQ ID NO: 147841 - DNA, 730 bp, Homo sapiens
  misc_feature: GYAE6OF02F5KFQ.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgcattgaccaaaaaatntgcttattggtaccagcagaagtcaggccacggcccctgtgcgtgtcatcgtacgaggacagcagaccgacccgtccgggactcccgtggacgagtacttctcgtcggcctaccgtaggttacgaacgggtactaacggtcgacctaccgttagaccgttcggtacgtacggggtccggggacccgtagggtagggacgggtaacgtaggaacgtcgttacggaaccttacgttaacgttacgtttaacctaccgtaaaacgacggtaactaggttaggttacgttacgtaccgtacgggttggggtttacgggttccgggaacggggtaacggtaacccggtaacgccgtttaccgggaccccggttaccgggttacggggtacccgtaaccgggaccccggtaaacgggttccccgttccccgggtaccccccgttaccgggttaccccgtacccggttttcccgttaccccgggtttacccccccg

SEQ ID NO: 147842 - DNA, 944 bp, Homo sapiens
  misc_feature: GYAE6OF02HPCRZ.26.67.G01.1.454.CMB.1.raw
tcagagactatactcacgaccggtgctcgatttagagtatacatattgggtttgggggtgggcgtcaggaggcagagctctgggaatctcaccatggcctggacccctctcctgcctccccctcctcctacctttctcgcacagtctctgacggcctcctactgagctgacacacgcccacccgtcggtcgtcgacgttcgtcccccaggaccgaaaaccggaccgtaacggactccaacccgtcggtccgtacccgggaaggtactcggtacgtacgtttacggaaaaacccgtaaaaaaaaaaaatacgtttacggaaccttttaaacgttttacggggttaaacccaaacggtacgaaacggtaaacgttaccgaacggtacccgaacggtcccccgtaggtaccgacgttcggtaccgtactaccgtaacggacggaacgacgacgaaccgaccgtacccccggtacggtacctcccgtagaacggacgtacttccgtacgtcggtaccttaccgtagttaccgaacgggtaactaaacgttccggggtaaccccttaaccgtttacgggtaaccttccggtacgggtaacgggttcccggggtacccggtaacggggtacggggttaacgggacggttaggaaaccgggtaccgtacggttaaacccgtaaccgtttaaccgttaacggttttaaccgaaaccgtaaaccgtaacgtaaaccggtaaccgggtttaggttaacggttaccgttacggtaaccggttacgggttccgggttacgggtaccgggggtacgaaccggttaaccgccggttaccggtaccggttccgggtaccgggtaccgtacccggtaaccgggtaaccgtccggttccccgggttaccccccgacgggtttaccccgaccggtttccccgttacccggtttccccccggg

SEQ ID NO: 147843 - DNA, 664 bp, Homo sapiens
  misc_feature: GYAE6OF02G8VIO.26.67.G01.1.454.CMB.1.raw
  modified_base (251)..(251): a, c, t, g, unknown or other
  misc_feature (251)..(251): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatcacctgctccggagatgctattacgaaaccaaaaaaatntagtactttaagttcggtaaccagtacaaggaagtcgacggccgacggcccctggtcgctggtaccagtcgtacggaggacaggacacggacccgaccccgtccgggactcccgtaggacgtagtacttctcgtcggcctaccgagttacgagggacaagtcgacctacttgactgtcgagggtcgggcctagggtgggaggtagtaggaagtcgtacgtaacctacgttacgttacgttacacgaacgacgtactaggtaagttgttactcgtacggttgggttacggttcggggacgggacggaaccgtaggtccgtacggtaccggttccggcgggtaccgaccggacccggtaaggtccccttaccggcccccggttacggtccctacgttcccgtacccgttcccccg

SEQ ID NO: 147844 - DNA, 774 bp, Homo sapiens
  misc_feature: GYAE6OF02I2P57.26.67.G01.1.454.CMB.1.raw
  modified_base (268)..(268): a, c, t, g, unknown or other
  misc_feature (268)..(268): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacacgcccacccgtcggtcgtcagttcgtacccccgaggaaccaaaccgccaggactccacctcgcgtaccgggagactgcgtagttacaaaacctaaaaaaatntagtactttagttacggtaccagaccaagaagtcgacggccacggccctgtcgctgtcatcgtagacgacagaccgacgaccgtcccgacgggactcccgtagagagtactttctcggtcgtcttaccgtagtaccggaagggaactaggtaccggacccttacgttacgacgttcggtacgtacgggtccggggtacccggtaggggtaggggaagggtacgttaacgggtaacgtccggttaacggtacccgttaaacgttaaccgtttaagttaaccctaaccgaaaccgtaacgaaacggttaacgttaagggttacgtttaacgtacggtaacggtttacgggttacggggtttaccgggacgggtacgggaaccgtaacgtaccgtacggttacccgttaccggttcgggtaccgtaccggaacccggtaacccggtccggtccccgtccccggttaccgtacccgtttaaccctcccggtttccccggttaccccccgg

SEQ ID NO: 147845 - DNA, 683 bp, Homo sapiens
  misc_feature: GYAE6OF02G2AQN.26.67.G01.1.454.CMB.1.raw
  modified_base (248)..(248): a, c, t, g, unknown or other
  misc_feature (248)..(248): n is a, c, g, or t
  modified_base (359)..(359): a, c, t, g, unknown or other
  misc_feature (359)..(359): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctgctccggagatgactattagaaaccaaaaaaaatntagtactttagttcggtaaccagcaagaagtcacggccacggccctgtgctggtacagtactacggagaacagcagaccgacccgtccggactcccgtgacgagtacttcncgtcgcctactggttacgagggacaagtcggacctacttgacttgcgtaggtcgggaccgaggtgggaaggtagtaggagcgtagaccttaacgtagttcttaaccgtacaactagtactaggttacgttgttaacgtcgtacggttacggggttcgggtcgggtaccgggtaaacggtacccgaagttcccggtacggtacccggttaccggttacggggtacccaaccgggtaccccggtaaccggttcccgttaaccccggtccccccggttacggttaccccggtacccgttttcccgttacccgttttaacccccccgg

SEQ ID NO: 147846 - DNA, 638 bp, Homo sapiens
  misc_feature: GYAE6OF02I2BBP.26.67.G01.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
tcagagactatactcacgaccggtgctcgatttagagtatacatattgggtttgggggtgggctcaggaggcagagctctgggaatctcaccatggcctggacccctctcctgcctccccctcctcacttttctgcacagtctctgaggcctcctatgagctgaccacagcccaccctggtgtcagtcgtccccaggacaaacggccaggatcacctgctcggngatgctatcgaacaaaaaatntgtcttattcggtaccagctaagaagtcgacggccgaacgtcccctgtgctcggtcacgtcgtacgaggacagcacgaccgacccgtcgggactccgagganagtactctcgngtcctactagttacgagggactaaggtcggacctacgttcgtacgtcggttacgagggtcggggacccgaggggtcggagggtagtaggaagcgtaacgtaactacgttacttagttaacctacgaaacacggtaacgtagttaggtaggttactacgtcgttggggttacgtcgggacgggaaacggtacgacgcgttacgccggtcggtcggaccgaacgtacccggaaggccgttccgaccccggttcggtacctccgtaccgttccgttcccccgg

SEQ ID NO: 147847 - DNA, 677 bp, Homo sapiens
  misc_feature: GYAE6OF02F16WZ.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcgagtgtccccaggacaaacggccaggatcacctgctccggagatgcattagaaccaaaaaaaatntgtacttagttggtaccagcagaacgtcgaggaccaggcccctgtcgctggtcatcgacgaggacagcgacgaccgtaccccgtaccgggactcccgtagaggacgtacgttctcgtcggtcctaccgtacgttcggaacgggactaacgtcgggtaccctaccgttcgacgttcggtactacggggtcggggtacccgagggtagggacggtaagtggaacggtcgtacgtaacttaccgttacgttacgttaccgtacaaccgagtaccgtaaggtacgttaggttagtaccgtagttacggggtgttacgggacgggacggtaccgaaggtccgtacgacccggtcggtcgggtaaccgacggtacccggacggtcccgtacccggtccccggttaccggtacctaccgttccgttccccgtaccccg

SEQ ID NO: 147848 - DNA, 575 bp, Homo sapiens
  misc_feature: GYAE6OF02GJ8M6.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaatntgcttattggtaccagcagaagtcaggccaggcccctgtgcgtggtcatctacggagacagcagaccgacccgtccgggactcccgtgagagattctcgtggcctccgtagttcgagggacaagtcggaccctacgttgactgtcgaggtcggggccctagggtgggaggagtggaagcgtagacctactacttgttaactacaacagactagttagtagttactacgacgttgggtgttacgggacggacggaacagcgtacgtaccgtcggtgggtacacggaccgaaggtccgtccggtccccgtcgtccgaccttccgtcgttaccccc

SEQ ID NO: 147849 - DNA, 691 bp, Homo sapiens
  misc_feature: GYAE6OF02I1HOC.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccaccctcggtcgtcagtcgtcccaggacaaacggccaggctcacctgacctccggagatcgactagttacgaaacctaaaaaaatctagtactttaagttcggtaaccgagacgaagtaacgtacgaacggaccacggccccgttgtcgcgtaggtactactacgtaacgacgggacacgcaacggaccgacccgtacgggacctccgtagagagtacttcgtacgtcggacttaccgtacgtacgtaacggaactaacgtcgtaccctaaccgttggtactacggtacgtacgggtccgggaccgtagggtacgggtaggagtacggaacgtcgtacgtaaccgtacttacgttacgtacctacgaaaccgagaacgttaggtagttacggttacacgttacgggtgggtacggtacggacgggtagaccgaacgtcgtacgtaccggtcggtacggtacgaaccggtacaccggtctaccccggtccgtcgtcctaaccgttccgttacccgtccccg

SEQ ID NO: 147850 - DNA, 637 bp, Homo sapiens
  misc_feature: GYAE6OF02GTTAU.26.67.G01.1.454.CMB.1.raw
  modified_base (244)..(244): a, c, t, g, unknown or other
  misc_feature (244)..(244): n is a, c, g, or t
  modified_base (577)..(577): a, c, t, g, unknown or other
  misc_feature (577)..(577): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaaaatntagcttatgtaccagcagaatcaggccaggcccctgtgctggtcatctacgaggacagcagaccgaccctccgggactccccgtggagacgtattcctacgtgggcctcgagtttccgaggggtaacaaacgttcgggaacccctaccgttcgacgttcggtacgagggttccggggcccgagggtaggggaggagttagggaagcgttagaccttaccttacgttgttaaccgtacaaaccgtagaccgtaaggttaggttgttaactcgtacgttggggtcggttacggtcgggaacgggaccaggtcgtcggacccgttcgtgggtaccnccggtacccgaaggtccgtccggtccccgtcggttcccacggttcctacccgttaccccc

SEQ ID NO: 147851 - DNA, 565 bp, Homo sapiens
  misc_feature: GYAE6OF02FHQEJ.26.67.G01.1.454.CMB.1.raw
  modified_base (239)..(239): a, c, t, g, unknown or other
  misc_feature (239)..(239): n is a, c, g, or t
  modified_base (301)..(301): a, c, t, g, unknown or other
  misc_feature (301)..(301): n is a, c, g, or t
  modified_base (546)..(546): a, c, t, g, unknown or other
  misc_feature (546)..(546): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtcccaggacaaacggcaggatcactgctccggagatgcattcgacaaaaaaatntgcttagtggtaccagcagaagtcaggccgacggcccctgtcgcgtggcatcgacgaggacngcgagaccgacccgtcgggactccctggagagtacttctcgtcggcctccgtaggttacgagggaactaagtcggaccctacgttgacgtgtacagggtcggggccagggtgggaggatgaagctagactacgtacttgttacacaacgagacgtagtagttgtatcgagttgggtgttcggcggacggaccagcgtcgaccgtcgtcggtcgaaccgccgacggcgtcccgcccgtccggtacnccgttccgtccgttccccg

SEQ ID NO: 147852 - DNA, 203 bp, Homo sapiens
  misc_feature: GYAE6OF02JBT9R.26.67.G01.1.454.CMB.1.raw
  modified_base (201)..(203): a, c, t, g, unknown or other
  misc_feature (201)..(203): n is a, c, g, or t
tcagagactatactcacgaccggtgctcgatttagagtatacatattgggtttgggctcaactctcttgtccaccaagggcccatcggtcttccccctggcaccctcctccaagagcacctctggggcacagcggccctgggctgcctggtcaaggactacttccagtatagtctctgagcgggctggcaaggcgcatagnnn

SEQ ID NO: 147853 - DNA, 678 bp, Homo sapiens
  misc_feature: GYAE6OF02FURMB.26.67.G01.1.454.CMB.1.raw
  modified_base (541)..(541): a, c, t, g, unknown or other
  misc_feature (541)..(541): n is a, c, g, or t
tcagagactatactcacgaccggtgctcgattttagagtatacatattgggtttggggggtgggcgtccaggagggacagagctctggggaagtctccaccatcggccttgggacccctctccgtgcccttcccccttccttccacgtttctcgtcactagtctctgagggtccctccgtactcgagctgaccacacgcccaacccgtccggtcgtccaggttcgtcccacgaccggacgaaacggccaaggactccaccgtcgacttccggagtattggacctaagttacgaccggaaaaaaatatgtcttttagttggtaccagacagaacgtcaggccaggcccctgtcgtctggtcacgtcaacgagacagcgacgacgaccgtccggactcccgtgacgcgtactttctcgtcggcctccgtacgttcgacggggaactacgtcggaccctaccgttgacctgtacgacgggtcgggaccgtacggtgggaggtagtacggacgtcgtagacttactacgtgttaccgacgaacgngaactagtacgtacgttactcgtacggtgggttcgggtcgggacggacgggtacctacggccgtacggtaccgtcggtcggtaccgacggacccgtacggtccctccggtccccgtgtccctaccgttccgttcccg

SEQ ID NO: 147854 - DNA, 747 bp, Homo sapiens
  misc_feature: GYAE6OF02JLZ2P.26.67.G01.1.454.CMB.1.raw
  modified_base (598)..(598): a, c, t, g, unknown or other
  misc_feature (598)..(598): n is a, c, g, or t
tcagagactatactcacgaccggtgctcgatttagagtatacatattgggtttgggggtgggctcaggaggcagagctctgggaatctcaccatggcctggacccctctcctgctcccctcctcactttctgcacagtctctgaggcctcctatgagctgacacagccacctcggtgtcagtcgtacccaggaccaacggccaggactcaccgtgactccggagactgacagttacgaacctaaaaaatctacgtacgttaagttacgacctagacgagaacgtacgaggtcccgaacgggtccccttaggtacgtacgttacggtactacgttaccgtacggaacgggaccaacgtaccgaacgacccggtacccgtaccggggtacctacccgtaggaacgtaacgtacttacgtcgtacggaccttaccgtaacggttacgaacgggtaactaacgtacgtaccgtacgttacgacgttacggtacgtacggtacgggaccgtaggtacgggaacggtacgtacggaacggtacgtacgtaacgtacgttaccgttagttaaccgacgtaaacgacgtaacgtaaggtaaggttntaacgtacgtacggttagggtcggttaacgggacggtaacgggaccgaacgtaccgtacggtaccgtcggtacggtactaaccgggtaccgtaacggtccgtaccggtccccgtaggtacccgtacttacccggtacccgttaaccccg

SEQ ID NO: 147855 - DNA, 809 bp, Homo sapiens
  misc_feature: GYAE6OF02FG25F.26.67.G01.1.454.CMB.1.raw
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
  modified_base (700)..(700): a, c, t, g, unknown or other
  misc_feature (700)..(700): n is a, c, g, or t
tcagagactatactcacgaccggtgctcgatttagagtatacatattgggtttgggggggctcaggaggcagagctctgggaatctcaccatggccctggacccctctcctgcctccccctctcacttctgccacagtctctgacggccctcctatgagtctgacacgacgcccaccctgggtatccacgtccgtacccgaggaaccaaccggccaggactccgacctgcnccggantgacctaacgtacaaccctaaaattcgtcgttccttagtcggaccgacgtcgaagcgtccgcggcccgtacggtccccgtgtccgtcgtacggtccacgttacgacgacggacngtacgccgtacccgtaccgtaccgtcctcggatacggtactcgttccgcgtacgtccttacggtaggtaaccggtaacgggtacctaccggtccggtacccttaccggttaccgtaccggttcggtaccgggtaccgggggtaccccgggtaagggttaccggggtaaggtacgtaacgtccgggttaaacccgtacgtacccgttttaaaaccctcggttaaacccttttaaaccggcctaaacgtaaccgggtaccttaagggtttaccggtttacgtaccgggtttacgacgggttacggtttaccggggttaagggacccggggttcggaaaccctaaacgggtntcccggtaaccggtttccccgaggttacccgaacgtacccggacccgttcccgtcccgggaccctcccggttacgtccccgttacgcccccgttaaccgtcccctacgg

SEQ ID NO: 147856 - DNA, 751 bp, Homo sapiens
  misc_feature: GYAE6OF02G20MD.26.67.G01.1.454.CMB.1.raw
  modified_base (182)..(182): a, c, t, g, unknown or other
  misc_feature (182)..(182): n is a, c, g, or t
  modified_base (237)..(237): a, c, t, g, unknown or other
  misc_feature (237)..(237): n is a, c, g, or t
tcagagactatactcacgaccggtgctcgatttagagtatacatattgggtttgggggggctcaggaggcagagctctgggaatctcaccatggcctggacccctctcctgcctccccctcctcactttctgcacagtctctgaggcctcctatgagctgacacacgccctacccgtcggtntcagtccgtaccccaaggaaccgaaaccggccaaggactccaccgtgcctcgganctgactatacgaaacctaaaaattctgtacttagtacggtaccagacgaagacgtacgacggaccgacggtccccgttaggtcgtcgtcggtactagtaccggtaacggacgacgacgaccgaaccggacccgtacccggtaccggtactcccggtagacggtacgtcgttccgtacgtcgtaccgtacggtagtaccgaacggactacggtacggtcctaccgttacgtacgtcgggtacggtcggggtaccgggacggtaggggtagaacgggtctaacgggacgtacgtaacgtaccttaccggttacttaacgttaacctacgaacggtacgttacggtaggttacgttgttacccggtaggttcggggttcggttacgggtacgggaacgtaacggacgtaccggttcgtaccggtaccggtcggtacggaacccgtaccggtacccgaccggttcccgtacccgtcccgtccgttcccgtaccgttcccgttacccctcccttaaccg

SEQ ID NO: 147857 - DNA, 701 bp, Homo sapiens
  misc_feature: GYAE6OF02G5Y83.26.67.G01.1.454.CMB.1.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgctcccccctcctcactttctgcacagtctctgaggcctcctatgagctgacacagccaccctggtgtcagtgtccccaggacaaacggccaggancacctgctccggagatgcattagaacctaaaaaaaatntagacttaattcggtaccagacagaagtacaggccaggcccctgtgctggtcatcgtacgaggacagcagaccgacccgtccgggactccctaggagagtacttcctcgtcggcctaccgtagttaccgaagggaaccaagtcgggaccctaaccgtttggaaccttggtaccgagggtcggggaccccgtaaggggtagggaacgggtaagtaggaaaggtacgtaaggtaaccgttaacgttaaccgttagtttaacctaacgtaaacgagtaacgtaaggttaaggttaggtttaactacgtaacggtttagggttacgggttcgggacgggtacgggaacccgtaaggtccgtacggacccgtttccggtgggtaccacggtacccgaacgggtcccgtacccggtcccccgttacggtaccctaccgttaccgttacccgttaccccccg

SEQ ID NO: 147858 - DNA, 719 bp, Homo sapiens
  misc_feature: GYAE6OF02G82Q6.26.67.G01.1.454.CMB.1.raw
  modified_base (245)..(245): a, c, t, g, unknown or other
  misc_feature (245)..(245): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctccggagatgcagttagaaccaaaaaatntgactttagttcggtaccagcaagaagtcacggccacggcccctgtgctggtcatcgtacgagacagcacggaccacccgtccggactcccgtggacgtagtacttcgtcgtcggccttcgtagttacgaacgggactaacgtccggaccctaccgtttagaccgttggtaccggtacggggttcggggacccgtagggggtacgggtaagggtacggtaggaaacgtcgttacgtaacccttaacgttaaccgttacgtttaaccctaccgaaacgtaacgaccgttagggttaacggttacgggttaactcggtaacgggtttggggttcgggttaccggggacgggtaacgggaaccggtaggtccggttacggtacccgggttacggtcgggttacccgaccgggtaccgtacggtcccgtcccgtacccggttcggtaccctaccggttccgttccccggttcccccgg

SEQ ID NO: 147859 - DNA, 687 bp, Homo sapiens
  misc_feature: GYAE6OF02I5712.26.67.G01.1.454.CMB.1.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtcccaggacaaacggccaggatcacctgctccgganatgcattgaaccaaaaaaaatntgcttattggtaccagcagaagtcaggccacggcccctgtcgcgtggtcattcgtacgaggacagcagaccgacccgtccgggactcccgtgaagacgtacttcgtcgtacgggtcctacccgtaggttacgaacggggtaactaaaggtccggaccctaccgtttacggaccgttcggtaccgtacgggtcgggggaccccgtaggggtacgggtaggagtaggaaacggtcgtacggtaacccttaacgttaaccgttacgtttaccgtaacaaaccgtagtaaccgtaggttaacggttacggttaacgtccgtaggtcgggttccgttacggggacgggtacggtaaccgagtcgtacgtacccggtacggtcgggtaccaccggacccgtacggccgttacccgccccgtacgttccgaccgttccgttccgtaccccg

SEQ ID NO: 147860 - DNA, 613 bp, Homo sapiens
  misc_feature: GYAE6OF02I5WAS.26.67.G01.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggntcacctgctccgganatgctattacgaacctaaaaaaatntgtactttagttacggtaccagacaagaagtcaggccacggcccctgtgcgtggtcatacgtacgagacgagcagaccgaccctccgggactccgtgagagtacttctacgtcgctccgtagttcgaggactagcgacctaccgttgactggtacgtaggtcggggaccgagggtgggaggataggaacgtcgacgtacgtactacgttacggttactacgtaacagtacgtaggttagttgttatcgtacggttgggttgttacgggcgggacggaccgagacgtcgtaccgtacggtcggtacgacggaccgacggtcctacccggcccgttcggtacctacccgttccgtccgttacccccg

SEQ ID NO: 147861 - DNA, 611 bp, Homo sapiens
  misc_feature: GYAE6OF02HGUD0.26.67.G01.1.454.CMB.1.raw
  modified_base (248)..(248): a, c, t, g, unknown or other
  misc_feature (248)..(248): n is a, c, g, or t
  modified_base (471)..(471): a, c, t, g, unknown or other
  misc_feature (471)..(471): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtgtccccaggaccaaaacggccaggatcacctgctccggagatgcattgaaccaaaaaaaaatntagcttattggtaccagcagaagtcaggccaggccctgtgctggtcatactacgagacagcagacgaccctccgggatcccgtgagagtatctcgtaggctccgtagttcgaagggacaaagtcggaccctaaccgttggaacctggtaccgtaggtacggggacccgtagggtacgggaaggtagtacggaaagtcgtagaacttacagttacgttacctanaacagtacctagtagtaggttaatcgacttgggtcgttacgggcggaggtaaccgaagtcgtcgaccgtcgtacgggtacgacgtacccgaaggtcgtaccgtccccgtcggtaccgaccgttccgttaccgttcccccg

SEQ ID NO: 147862 - DNA, 695 bp, Homo sapiens
  misc_feature: GYAE6OF02G1ZK3.26.67.G01.1.454.CMB.1.raw
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaaccaaaaaaatntgtacttagttggtaccagcaagaatcgaaggccacggccccngtgctgtcatcgtacgagacagcaacgacgacccgtccgggactcccgagagagtacttctcgtggctccgacggtttcacgggaactaacgtcgggtaccctaacgtttcgaacttccggtacgtaagggggtcccggggacccgtaggggttacgggaagggtacgttagggaaacggtcgtacggtaaccttaacttaaccgttcggtttaacctacgaaaacgacgtaacgtaggttacgttaggttaactacgtcgggttacggggttcgttccggggtaacgggacgggaaccgtaacggccgttaccggaaccggttcccgggtgggttaccgacccgggtacccgacggtcccgttaccgcccccggttggaccctaacccgtttcgtcccgttacccccc

SEQ ID NO: 147863 - DNA, 604 bp, Homo sapiens
  misc_feature: GYAE6OF02FUWU2.26.67.G01.1.454.CMB.1.raw
  modified_base (248)..(248): a, c, t, g, unknown or other
  misc_feature (248)..(248): n is a, c, g, or t
  modified_base (537)..(537): a, c, t, g, unknown or other
  misc_feature (537)..(537): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctgcctccggagatgcattcgaacctaaaaaaatntgtacttattcggtaccagcagaagtcaggccaggcccctgtgctggcatcgtacgaggacagcaggaccgacccgtccgggactcccgtagacgagtacttcgtacgtggctcccgtaggttaccgaagggtacctaaagtcggacccctaccgttcggaacgttcggtacgtacggggtccggggcccgtaaggggtcgggaagggtagtaggaacgtcgtagaacctacttaacgtcgttactacgaacagacgtaagttagttgtatcgtaggtggttcgtcggnggacggacgagcgtgtccgtcgtggcacggccgagccgtccgcccgttgccgtctccgtcctccccg

SEQ ID NO: 147864 - DNA, 844 bp, Homo sapiens
  misc_feature: GYAE6OF02GZFDG.26.67.G01.1.454.CMB.1.raw
  modified_base (242)..(242): a, c, t, g, unknown or other
  misc_feature (242)..(242): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagccaccctcggtgtccagtgtccccaggaccaaacggccaggatcacctgctccggagatgcattgaccaaaaaaatntgcttattggtaccagcagagtcaggccacggcccctgtgcgtggtcatcgtacgaggacagcagaccgaccctccgggatccccgtgacgagtactttcgtcgtacggcctccgtaggtttccgaggggaaccaaacgtcgggtaccctaaccggtttacggaccttcgggttaccgtacggggttccggggggaccccgttaacgggggtacgggtaaacggggtaaggttacgggaaaccggtacggttacggtaaaccgtttaacccggttaacgtttacgggttttaaaccctaaccgtaaaaccgtaacggaaaccgttaagggtttaacgggtttacgggtttaacgttacccgtaacggttttcgggggttaccgggttttccgggggaaccggggtaaccgggggtaaacccgtaaacgggtcccgttaccgggtaccccgggtttcccgggttaccggggggttaaccctaaccggggaccccccggttaaacggggtcccctttacccgggtaccccccccggtttacgggttacccctaaccccggttttccccgtttaccccgggtttacccccggttaaccccccccg

SEQ ID NO: 147865 - DNA, 739 bp, Homo sapiens
  misc_feature: GYAE6OF02IEK7R.26.67.G01.1.454.CMB.1.raw
  modified_base (179)..(179): a, c, t, g, unknown or other
  misc_feature (179)..(179): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctggtntcagtcgtcccaggaccaaacggccaggactcacctgctccggagatgactattacgaaccaaaaaatgtgtcttaagttcggtaccagtacaagaagtcgacggaccgacggccccgttgtacgtcgtaggttacacgttcgtacggacggtacagccgacgaccggacccgtacgggactcccgtaggaacgtgtacttcgtcgtcggtcttaccgacgttcgaacgggtaacacggtccggaccctacgttacggtacgttacgtacggtacgggttccgggacccggtagggtacgggtacggaacgttacgggaaaggtccgttacgtaaccgtttaccgtaacgtttacggttaacctacgtaaacgtacgtaacgtacggtttagttacggttaacgtcgtacgggtttcgggttacgttccggggacggtacggtaacgacgtaccgttacggtacccggttacggtccggtaccgaccggtacccggtaaccgtccgtcccggttaccccgttaccggtaccgtacccgtttccgtccccggttacccccg

SEQ ID NO: 147866 - DNA, 775 bp, Homo sapiens
  misc_feature: GYAE6OF02INDN5.26.67.G01.1.454.CMB.1.raw
  modified_base (259)..(259): a, c, t, g, unknown or other
  misc_feature (259)..(259): n is a, c, g, or t
tcagagactatactcacgaccggtgctcgatttagagtatacatattgggtttgggggtgggctcaggaggcagagctctgggaatctcaccatggcctggacccctctcctgcctccccctctcactttctgcacagtctctgaggcctcctatgagctgacaacacgccacccgtggtgtacagtcgccccgaggaaccaaacggccaggagtccacctgcgtccggagactgaccattacgaaacctaaaaaaatntagtactttaagttcggtaaccaggaccaaggtaaacggtccgaacgggtccaaccgggccccgttggtacgcgttacgggtcaagttaccgtaacggaggaacacggacgaacggaccgtacccgtaccgggacctcccgaggacgtacgtacttcgtctgggccttactaagttacggaacggtactaacgccggtacctacgttaggtaccgtacgtaccggtagggtccggggacccggtaaggggtaccgggaagggtacgtaagggtaacgtacgtacgtaaccttacgttaacgttacttacgtaccgaaacgaacgtaccggtaagttaggtacggttacgtacgtacgggttaggtacgggttacgggaaccgggtacggtaaaccgacggtacgtaccggtacggttccgggtacgggtaccgaacccggtacccggtaacggtacccgttaccgggaccccgtttaccgggtacctcccggttacccgttacccggttacccccg

SEQ ID NO: 147867 - DNA, 738 bp, Homo sapiens
  misc_feature: GYAE6OF02JKR1K.26.67.G01.1.454.CMB.1.raw
  modified_base (257)..(257): a, c, t, g, unknown or other
  misc_feature (257)..(257): n is a, c, g, or t
  modified_base (392)..(392): a, c, t, g, unknown or other
  misc_feature (392)..(392): n is a, c, g, or t
tcagagactatactcacgaccggtgctcgatttagagtatacatattggggtttgggggtgggctcaggaggcagagctctgggaatctcaccatggcctggacccctctcctgcctccccctcctctactttctgcacagtctctgagcctctatgagctgacacacgcccaccctggtgtcagtcgtaccccaggacaaacggccaggatcacctgcgtccggagatcgactagttacgaaaacctaaaaaaatntagtactttaagttacggtaaccagacgaaggtaagtacgacggaccgaccggtccccgtggtacgtcgtacgtactacgtaacgtacggacgacgacgacgaccgacccgtccggaccgtaccgtcgagacgtntactcgtcgtcgcgttacgacggtacggagtaacgtacgtccgtaaccttcgtacgtacgtcggtacggtcggggacccggtacgggtagggaacggtaggtagtaacggagttacgtacgtaaacgttccttaaggttacttaccgtaaacgtaagaacgtacgtagggttaacgtacgttaccgttacgggtacggtacgggtttacgggccggggtaaacggacgtaacggtacgtccggtaccgttaacggcggttacggaaccgtccggtaaacggcccggttacccgttaccccggttccggtaccgttacccgccgtttaccgccccggtttacccccc

SEQ ID NO: 147868 - DNA, 679 bp, Homo sapiens
  misc_feature: GYAE6OF02ICX9M.26.67.G01.1.454.CMB.1.raw
  modified_base (243)..(243): a, c, t, g, unknown or other
  misc_feature (243)..(243): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccacccctcggtgtcagtcgtcccaggacaaacggccaggatcacctgctccggagatgcattgaaccaaaaaatntgtacttagttgtaccagcgagaagtcgacggccacgcccctggtgccgtggtcatcacgaggacagcagaccgacccgtccggactcccgtgagagtattcgtcgtcggctacctagtcgacgggtacaagtcggccctaccttgacttcggtcgaggtcgggcccgtaggggtacgggaggagtaggtaagcgtacggtacttaccgttaacttcgtttacctacgtaaacaacgtaacgtaaggtttaggttacggtttaagttccgtaacgggttggggtttacgggttccggggtaaccggggtaaccgggtaaacccgaaggtacccgggttacggaccccgggttccggtacgggtacccgacggtaacccgacggtcccggtcccgtccccggtcccggtaccgtcctccccggttcgttcccccccg

SEQ ID NO: 147869 - DNA, 631 bp, Homo sapiens
  misc_feature: GYAE6OF02J0BRS.26.67.G01.1.454.CMB.1.raw
  modified_base (136)..(136): a, c, t, g, unknown or other
  misc_feature (136)..(136): n is a, c, g, or t
  modified_base (166)..(166): a, c, t, g, unknown or other
  misc_feature (166)..(166): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (428)..(428): a, c, t, g, unknown or other
  misc_feature (428)..(428): n is a, c, g, or t
tcagagactatactcacgaccggtgctcgatttagagtatacatattgggtttgggggtgggctcaggaggcagagctctggaatctcaccatggcctggacccctctcctgcctccccctcctcactttctgcanagtctctgacggcctctatgagctgacacncgcctacccgtggtgtctagtcgtccccgagacaaccggcgaaggactcgacctcgcgtccgganattgcattgaacaaaaatntntacttattcgacngtaccagagtacgacgcctacggcctagntcgtaggtctacgtcgagaggacagtcgaacgccgacccgtacggactccgtaggagactnttctctcggacctaccgtggtaccgaggtacagtccgctaacgtcgagtcgtcgtacggtcgggacgtagggngtacggagttacgaagtctagtaccttacgttcgttacgttacgtacaacctacgactacggttagttacgttacgtcgttacggttacgggttggttacccgggagggtaaccgaaccgtggacgtacggtacgtccgtcggacgtaccgtacgtacggtcccgtccgtacccgccgttacctcgtaccctccgttaccccg

SEQ ID NO: 147870 - DNA, 914 bp, Homo sapiens
  misc_feature: GYAE6OF02JKZXB.26.67.G01.1.454.CMB.1.raw
  modified_base (254)..(254): a, c, t, g, unknown or other
  misc_feature (254)..(254): n is a, c, g, or t
tcagagactatactcacgaccggtgctcgatttagagtatacatattgggtttgggggtgggcgtcaggaggcagagctctgggaatctcaccatggcctggaccctctcctcgctcccctcctcactttctgcacagtctctgacggcctcctatgacgctgacacacgccaccctcggtgtcagtcgtcccgacggacaacggccaggatcactgcgtccggagtactgcaagttacgaacctaaaaaaatntacgtactttaagttacggtaacctaggactaacggaacgtacgacggacccgtaacgggcccccgttaggtcggtcgtcggttaccgtaacgttaccgtaacggtaacggaaccgacggaccgacggaaccccggtaaccccggttaccggggaaccgttccccggtagggaaaccggtacgtacgttccgttacgtcgggtacctttccgtaaggttaccgggaacgggtaaacctaacggtcgggtacccttaaccggttcgtaacggttcggtaccggtacggggtaccgggggtacccggtagggggtacgggtaagggtaacgtaaggggtaacgtacggttacggtaaacccgttaacgtttacccgttaacggtttaaccttaaaccgtaacggtaacggttaaacgtacggggtttaaacgttcggtttaacgtcgggtacgggtttaccgggttacgggggtttaccggtaaccggggggtacgggaaacccgttaagggttacccgggtaccggttacccggggtaccgggtttacggggtacccgtaacccggggtacccgttaaccggggtaccccgtccccgggtttaccccgttaccggggttaccctaacccgggtttcccgtttccccgggttacccccccgg

SEQ ID NO: 147871 - DNA, 802 bp, Homo sapiens
  misc_feature: GYAE6OF02G0JU6.26.67.G01.1.454.CMB.1.raw
  modified_base (252)..(252): a, c, t, g, unknown or other
  misc_feature (252)..(252): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacagcccaccctcggtgtcagtcgtccccaggacaaaccggccaggactcacctgctaccggagatgactattacgaaacctaaaaaaatntacgtactttagttacggtaaccagacgaagtaacgtccggaacggtacccgacggtccccctaggttcggcgttcgggtacacgttaccgtaacgggacggaaccgtacggaccgaacggtaccccggtaccccggttaccggggaccttcccggtaggaacggtacgttactttcgtcgtacggcctacccgtaggttccgaacgggtactaacggtccgggtaccctacgttacgtaccgttcggtaccgggtaacggggtccggggtaccgagggggtacggaagggtaacgtacggaacgtacgttacgaaccgtttacgtttaccttacgtttaacaaccgtaaacgtacgtaacgttaggttacggtttaacgttcggttaccgtagggtttcggggttacgggttacgggacggggtaacggaaccgtacggtcgttacccggccggttcggtacggaccgtaccggacccgtacggtcccgttacccggtccccggtaccggtcccgttaccttccccggttacccgtaccccgtaccccg

SEQ ID NO: 147872 - DNA, 756 bp, Homo sapiens
  misc_feature: GYAE6OF02F65DG.26.67.G01.1.454.CMB.1.raw
tcagagactatactcacgaccggtgctcgatttagagtatacatagttgggtttgggggtgggctcaggaggcagagctctgggaatctcaccatggcctggacccctctcctgctccccctcctcactttctgtcacagtctctggtacggcctcctatgtagctgacacagccaccctcggtgtctaggtcgtccccgaggacgaaacggccaggactcaccgtggccgtacccggagatcgtctacttacgaaacctaaaaaaaatctacgtactttagttacggtaaccacgacaagtaacgtcgaacggaccaaccggcccctggtagtccgtcgggtaccacgttacgtacgacggacgacggaccgaacggtaccggaccccggtaccgggtaccgtacccgtaggtaacggaagttaccttcgtccgtaggccttccggtaagttaccgaagggtaacaagtcgggtacccaaccgttacgaccgtacgtaccggaggggtacccgggtacggtacgggtacgggtacggtagtacggaacgtacggtacgtaacgtaccttacgttacgtacctaccgaacgtagactaggttagtacgttagtctacggtgggttacgttcggacggtaaccggacgtaacgtccggtacgtaccggttaccggtacggtaccgtaccggaaccggtaacggtcccgtaccggtccccgttacggtaccgtaaccgttccgttacccgtcccccgg

SEQ ID NO: 147873 - DNA, 939 bp, Homo sapiens
  misc_feature: GYAE6OF02HK22U.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctctactttctcgcacagtctctgacggtcctcctatgacgctgacacagcccacccgtcggtcgtcagtcgtccccaggaaccaaaccggccgaggactccaccgtgccgtaccggagtatcgactattacgaaacctaaaaaatctacgtactttagtttacggtaccagacgaacggtaacgtaccgacggtacccgacggtcccccgttaggtcgtccggttcggttacctaacttaccggtaaccggaacggaaccgacggaccgtaaccggaaccccggtacccccggtaccggggtaccttccccgtaggaacggtacgttacctttccgtcggttccgtacccgttaccgtacgggtttaccggaacgggtaaccgtaacggttcccgggaaccccgtttaaccgttacggggtaaccctttacgggttaccgggtaacggggttcccggggaccccggttaggggttacgggggaacgtaaggttacgaaacgtccgttacggtaaccctttacgttaccgttaacgttttaaccgtaaccgaaacgtacgtaacggttaggttacggtttaaggttaccttaccggttacgggtttacgggttccgggttaccgggacggggtaaacccggtaaaccggtaacggttccggtacccggttaccccgggtttaccggtaacccgggttacccggaacccggttaaccccggaccgggttacccccgttaccccccgggtacccccgggtttacccggttacccccgtaccccggttttcccgttacccccccggtttacccccccgg

SEQ ID NO: 147874 - DNA, 864 bp, Homo sapiens
  misc_feature: GYAE6OF02IFVMK.26.67.G01.1.454.CMB.1.raw
  modified_base (262)..(262): a, c, t, g, unknown or other
  misc_feature (262)..(262): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccaccctcggtgtcagtcgtaccccgaggaaccaaacggccagggactccgacctcggcctaccgggagatcggcagttacgaaccaaaaaatntagtcttagttacggtaccagacaaggtaacgtcgacggaccgacggtaccccctggtacgtccgtcgggtacctacgtaccgttaacggacgggtaacaggtaccgtaacggaacccggtacccccgtaccggggtaacttccccgttacggaacgtacgtaccgtttcgttccgtacggtacctcccggtacgtttacggaacgggtaactaaacggtccggaacccttaccggtttacgacccgttcggttaccgaggggttacccggggtcccggtaacggggtaccgggtaagggtaccgtacggtaacgtacgtaacggtaccttaacgttacgtttaaccgttaaccgttaaccgaaacgttacgaacgtacggtttacggttagttaacgtaccgtaacgggtttcgggttaccggttacgggtaccggggtaaacgggtcccgttaacgggaccgttacccggtaacccggttccggtaaccgggttaccggaacccggtacccgggttaaacggtccccggtttaccccggtaccccgggttaacccggttccccgttaaccggttcccgtttaccccggttaaccccccgg

SEQ ID NO: 147875 - DNA, 798 bp, Homo sapiens
  misc_feature: GYAE6OF02IN618.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgccaccctcggtgtcagttcgtccccaggaccaaacggccaggatcacctgcgtcccggagatgcctattacgaacctaaaaaaatctagtctttaattcggtaacccagacctaggaaacggttccgaaggccgacgggtccccgtttgtcggtccgtaggggtcctagtccgtaaccggaggaccacggtcacgaccggtaccccgtccgggacttccccgtagacgacggttaactttccgtacgttcgggtaaccttccgaacgttttaccggaacgggtacgtaaacgtcggtacccttaaccgttcgaacttcgggtcgaaggggttccggggacccgtaggggttgggaaccgggtatacgggtaaacgtcgttacgggaacctttaacgttacgtttacgttacctaccggtaaaccgtacgaacgttaggttaacgggtttcgttaagttaccgttaccgttagggggttcggttaccggggaacgggtaacgggccgaacgggttccgtaccggttacccgggtctaaccgggggttccaaccggtccccggtaaggtcccgttacccggtaccccgttaccgggttcccgtacgttccccgttaccgggtttacccccc

SEQ ID NO: 147876 - DNA, 760 bp, Homo sapiens
  misc_feature: GYAE6OF02I5FA8.26.67.G01.1.454.CMB.1.raw
tcagagactatactcacgaccggtgctcgatttagagtatacatattgggtttggggggggcgtcgaggaggcagagctctgggaatctcaccatggcctggacccctctcctgcctccccctcctctactttctgcacagtctctgacggcctcctatgagctgacacacgcccacctcggtcgtcagtcgtacccaggacaaccgcaggactaccacctcgcctccggagactcgactagttacgaaaaccaaaaaaatctagtacttagttacggtaccagcgaagaacgtccgaacggtccgaccggtcccgttggtacgtcgtcggtactacgtaccggtaacggtacggacgacggtacgaccgaaccggtaccccggtccgggtactacccgtaggacgtaacgtaccttcgtacggtcgccttacgtacggttcgaacgggtaacacggtcggtacctaccgttacgaccgttagtaccgtacggggtccggggacccgtagggggtacgggaaggttacggacggttaacgaccggtagttaaacccgtacgttccttaaccggttaactaccgtaaacgtaacccggagtttaacggtcgggtttacgttacgtacgtcggttaggggttccggtacggggtacggaacggacgtacgtacgtccggtacccgttacggcggtaccaaccgggaccgtaacgccgtacccgtcccggtacgtccgtacgtcccgttcccggtcccctccg

SEQ ID NO: 147877 - DNA, 653 bp, Homo sapiens
  misc_feature: GYAE6OF02IXK4D.26.67.G01.1.454.CMB.1.raw
  modified_base (180)..(180): a, c, t, g, unknown or other
  misc_feature (180)..(180): n is a, c, g, or t
  modified_base (388)..(388): a, c, t, g, unknown or other
  misc_feature (388)..(388): n is a, c, g, or t
  modified_base (471)..(471): a, c, t, g, unknown or other
  misc_feature (471)..(471): n is a, c, g, or t
  modified_base (511)..(511): a, c, t, g, unknown or other
  misc_feature (511)..(511): n is a, c, g, or t
  modified_base (570)..(570): a, c, t, g, unknown or other
  misc_feature (570)..(570): n is a, c, g, or t
tcagagactatactcacgaccggtgctcgatttagagtatacatattgggtttgggggggctcaggaggcagagctctgggaatctcaccatggcctggacccctctcctgcctccccctcctcactttctgcacagtctctgaggcctcctatgagctgacacagcccacccgtcggtntcgagttcgtccccgaaggaccgaaacggccgaggactacacctgccgtaccggagtatcgactagtttacgaaaccctaaaaaaaattcgtagtacttttaagttacggttaaccagcaaggtaacgtcgaacggccgacggcccccgtgtgctaggtccagttcgacggagacgagcgtacgaccgtccccgaccgggtactccgngtagcgtattcgtcgtcgactacgtagtcggaggacaagtcgacctacgtgtacgtgcgtaggcgggaccgtgggtaggacgngtagaagcgtacgtacttacgtacgtacgttacacaacgngtaactagtagttggtataccgtagttacgggtcgttacgggcgggacggaccgtacgnggtaccgcgttaccggtcgtacggaccgtccggaacgtccgtcccggtcccgtccgtcgtacctccgttccgttccctacccg

SEQ ID NO: 147878 - DNA, 747 bp, Homo sapiens
  misc_feature: GYAE6OF02FT0X7.26.67.G01.1.454.CMB.1.raw
  modified_base (257)..(257): a, c, t, g, unknown or other
  misc_feature (257)..(257): n is a, c, g, or t
  modified_base (334)..(334): a, c, t, g, unknown or other
  misc_feature (334)..(334): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacacgccacccgtcggtgtcagtcgtccccaggacaaacggccaggatcacctgccgtaccgggagagtcgactattacgaacctaaaaaaatntagtactttagttacggtaccagtacgaagaacgtcgacggccgacggcccctgtcgctggtcagtctacggagacngacgacgaccgtcccgtccgggactcccgtagacgtacgtattccgtcgtacgtcctaccgtacgttcggaacggactaaggtccgacctacgttcgactgcgacggtcgggacccgagggtacgggagtacgtaggacgtcgtacggtactaccgttacgttacgtaacctacgtaacgtacgtacggtaagttacgggtttagttaaccgttcggttacggttggggtttaccgggtacggggtaaccgggtaaccgggtaaccgtaacgggtccgttacccggggtacccggttcgggttccggggaaccgtacccgggtaaccccggtaacggttccccgtaccccgggtacccccggttttaccggaccccgttcccgtttacccggttacccccgtttaccccccgg

SEQ ID NO: 147879 - DNA, 612 bp, Homo sapiens
  misc_feature: GYAE6OF02I05NP.26.67.G01.1.454.CMB.1.raw
  modified_base (350)..(350): a, c, t, g, unknown or other
  misc_feature (350)..(350): n is a, c, g, or t
tcagagactatactcacgaccggtgctcgatttagagtatacatattgggtttgggggggctcaggaggcagagctctgggaatctcaccatggcctggacccctctcctgctcccccctcctcactttctgcacagtctctgaggcctcctatgagctgacacacgccaccctcggtgtcagtcgtccccaggacaaaccggccaggactcacctgctccggagatgcattagaaccaaaaaaatctgcttagttggtaccagacagaagtcaggccaggcccccgtgtgctggtcatctacggaggtacagcacgacgaccccgtccggactcccctgacagacttcncgtggcctctagtcgaggacaagtcgacccacttgactcgtcacggtcggggcccgtagggtggaggacgtgagtctacgacttaccgtactttcggttaactacaacgtagaacgtacggttacgttaggttaattccgtacgttggggttacggttcgggacgggtaacgggcctaaggcgtacgtaccggtcgtacggtcacggaccgtagccgtccggccccgtcggtacctcgtcccgttccgttacccctaccccg

SEQ ID NO: 147880 - DNA, 853 bp, Homo sapiens
  misc_feature: GYAE6OF02HEASP.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctcccctcctcactttctgcacagtctcgtgacggcctcctatgagctcgacacgacgcccacccgtcggtcgtacgagtccgtacccgaggaaccgaaaccggccgaggactaccaccgtcgccgtaccgggagtacgtcgacgtaacgttaacgaaaaacctaaaaaaaattcgttacggtaccttttaagttacggaaccctaggaccgaaaggtaacgtccggaacggacccgtaccggtccccgtggtccgtcgtacggtactacgttaccgaacggaacggacgacgaccgaccggaccccggaccccggttaccggacttcccggaagaggtaacgttacgttcgtcgtccggtaccttcggtaaggttaccggaaaggtaacgtaacgtccggtaacctaccgttcggaccgttacgtacgtacgggtacgaccggtaccgggaaggggtttcggaaacgggttagtacgggaaaccgtcgtaacggtaactttacggtaacttttacgtaaaccacggtaaactaacgggtacttaacgggtttacgttaacggttaccgtaggttacggggtttacggttccggggtaaccgggtaacggaaacccgtacgtaaccggtcggttaccgggttaacccgtgggttccggaaccgtaccgtaacccggggtagttccccggtcccgtaccccggtttacggtccctttacccggtacccggtttcccccgg

SEQ ID NO: 147881 - DNA, 677 bp, Homo sapiens
  misc_feature: GYAE6OF02HIZ22.26.67.G01.1.454.CMB.1.raw
  modified_base (553)..(553): a, c, t, g, unknown or other
  misc_feature (553)..(553): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctcctgacggcctcctatgagctgacacagccaccctcggtgtcagtcgtaccccaggaccaaacggccaggactccacctgccgtccggagatcgctacttacgaaacctaaaaaatcgtagtactttagttacggtaccagtacgaaggtaacgtcgacgggtcccggtccccgtaggtcgtaccgtggtacctagttaccgtaaccggaggacctacggaccgtaacggaccgtaccccgtaccgggtctcccgtaggagtacgtacttcgtacgcgtctaccgtagtcgacggtacacgtcgtaccctacgtcgacgttcgtacgtagggtccgggacctaggggtcggacgtaagtgaacgtcgtacgaccgttatacgtgttaccacagtacgagttagtggttactntaccggtggtggttaccggacgggaccgggaagtacccgtgtcccggtacgtacggttcgtaccggcaaccggtccggagtccgtccccgtccgtagccttaccggtccttacccgccctaccg

SEQ ID NO: 147882 - DNA, 868 bp, Homo sapiens
  misc_feature: GYAE6OF02IYL7F.26.67.G01.1.454.CMB.1.raw
tcagagactatactcacgaccggtgctcgatttagagtatacatattgggtttgggggtgggctcaggaggcagagctctgggaatctcaccatggcctgggcccctctcctgctccccctcctcactttctgcacagtctctgaggcctcctatgagctgacacagccacccctcggtgtccagtcgtcccccaggacaaaacggccaaggatcaccgtgctccgggagatgacagttacgaacccaaaaaaaattcgtagtacttttacgttggttacccaagtccgaaggtaaacgtcgaacgggtccaacgggccccccttggtcggccgttggtacctaacgttacctaaccgggaacggtaaccgaggtaccaacgggtaacccggacccccggttaccggggtaacctccccggttaaggacggtaacggtaacctttcgtccgttacggggtacctttacccgtaacggtttccgaaacggggaacctaacgttacccggggaacccttaccctttaacgggacgtttacggttacggtaacggggttacccgggggtaccccgtaagggggttacgggaaacgggtagtaacgggaacgtcgtacggtaaccgtaaccgtttacgttaacgtttaccgtaacgtaaaccgaacgtaaccgtaagggttaaccggttagttaaccgttacggtaacggttcggggttacgggtttaccggggtaccgggtaacggggaaacccgtacggaccgttaccgggtaccggttccggttacgggtaccgacccgggtaccggaacggttccgtcccgggtaccccgttccgggtaacctcccgttaccgtcccgttaccccccg

SEQ ID NO: 147883 - DNA, 1124 bp, Homo sapiens
  misc_feature: GYAE6OF02H3LXE.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagccgtacgaccacgacgacccctacccgtcggttcgtacgtaggtcccgtaccccgaaggaaaccgaaccgggaccgaaggactccgaaccgtcgaccgtaccgggagtagtacgacgttagtaaccgtaaaaaactaaaaagttcgtacgttactttaacggtacggtaaccgagacggtaaaggtaaccgtcggaccggacccggtacccggtcccgttggtaccgtccggttacggtacgttaaccgttaccggaacgggaacggaaccgacccgggacgtaaaacccggtcccccgggtaacccccgttaccggggtacccttaccccggtaagggtacgtaaccggttaccgtttcccggttcggttacccggtacccgttaaccggttaacggtacgggtaaaaccggtaacgtttaaaccgggccccgttaaacccggtttacccgtttaacgggtaccgtttacggggtaaaccccggtttccggggggggtacccggggtaaaccccggggtagggggtttaaaccgggggaaaaccgggttttacgggaaccgggtaaaccgggtttaaccggtaaccgttaaaccccgggttttaaaacccgttttaccggtttaaaccggttaacccgtaaaccccggtaaaaggttaaccgtaacggggttttaaaccggtcggggtttttaaaccgtttaaccggtaaccggggttttaaccgggggttacgggggttttacccgggaccggggttaaaccgggggtaacccgaaaccggttaacgggtacccgttacccgggggttaaccccggtcggggggttaaaccctaacccggtaccccggggtaaacccggttaccccgggtaacccgggtttccccccccggtaacccgggtttcccggtaaacccccggtttcccgggttttccccggttaacccccccgtttccccccggg

SEQ ID NO: 147884 - DNA, 807 bp, Homo sapiens
  misc_feature: GYAE6OF02FTBGR.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacacgcccacccgtcggtgtcgacggtcgtccccgaaggaaccaaacggccgaggactccaccgtcgccgtaccggagacgtgactacgttaacgaaaacctaaaaaaaattgtacgttactttaacgttacggtaaccagaccgtaaaggtaacgtacgaaccggccgtaccgggtccccgttggtcggtcgttccggtactacgtaccgtaacgggaggaccgacgtacgaaccggaacccggaccccggtccgggtacctcccggtaggaacgtacgtacttccgtcgtccgtaccgtccgtacggttacgaaacggacctacgtccgtacctacgttacgtcgttcgcggtcggggcccgggtaccggtagggtacgggaaggtagtcgggaacgtacggttacgtaaccgttccgttaagtttaccgttacctaacgtaacgaacgtaacgtagggttagttacgtaacgttcggtacgggttggggttccgggtacgggtaaccgggaaggtacccgtacggacccggttacgggacccggttcggttaacgggtccaccgggtaacccggacggttacccgtcccgggtaccccgttcggtaacccgttcccgttccggttacccccgttccccgg

SEQ ID NO: 147885 - DNA, 860 bp, Homo sapiens
  misc_feature: GYAE6OF02GJLAG.26.67.G01.1.454.CMB.1.raw
  modified_base (247)..(247): a, c, t, g, unknown or other
  misc_feature (247)..(247): n is a, c, g, or t
tcagagactatactcacgaccggtgctcgatttagagtatacatattgggtttgggggggctcaggaggcagagctctgggaatctcaccatggcctggacccctctcctgctcccctcctcactttctgcacagtctctgaggcctcctatgagctgacacagccaccctcggtgtcagtcgtcccaggacgaacggccaggatcacctgcgtccggagatgacagttacgaaccgtaaaaaaatntacgtaccgtttaagttaggtaacccaaggccgtaaaggaaaggttaccaaaggggccccaacggtccccccgttaggtacggtccttcgggtaccaacttcgttaacggacggacacggcctaacggaccgtacccgtccgggacttcccgtagacggtaacgtagttccgtaccgtcgtcctaccgtacggttaccgacgggtaacctaaggtccgtaccgtaccgttacgacgttacggtacgtacgggtcggggtacccgtagggtacggaacgggtagtaggtaaacgtccggtacgggtaaccttaaccttacggtttacgttaaccgtaccgtaaacgtacggtaacctaagggtttacgtttacgggttacttaccggtacggtttacgggggttacgggttaccggggaccggggtaacgggtaaccgtaaacggggttcccgtacgggttacccggttaccggttagggtccccggttaacgggacccccggtaaacgggttcccccggtaaccccgggttccccccgggtttacccgggtttaacccgttaccccgggtttccccgtttttaccccgggtaccccccgttttaccccccggg

SEQ ID NO: 147886 - DNA, 742 bp, Homo sapiens
  misc_feature: GYAE6OF02F096F.26.67.G01.1.454.CMB.1.raw
  modified_base (252)..(252): a, c, t, g, unknown or other
  misc_feature (252)..(252): n is a, c, g, or t
  modified_base (460)..(460): a, c, t, g, unknown or other
  misc_feature (460)..(460): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtcccccaggaccaaacggccaggatccacctgcctccggagatgcattacgaaccaaaaaaaatntagctttagttcggtaccagacagaagtcgacggccacggcccctggtcgccgtggtcctaagtccgtaacggacggacgacggacgacggacccgaaccccggtcccggggtacttccccgtaggaagtacgtacttctcgtcgggtcctaccgtagttccggaacggacaagtccgggtaccctacgttacggacgttcgtaccgnggggtttacccggggccgtacggggtagggacgggtaagtacgggtaacgtcgtacggaacccttacgttaaccggtttactactaccgaaacgaacgtacggtaacggttagttaccggttaactccggtaacggttgggtttacgggtcggggacggtaacgggaaccgtcggtaccgtacggttccgggtaccggtgggtacccaccgggtaacccgtaacggtcccgccccggttcccgggtctaccctcccggtttccccgtacccgttaccccccg

SEQ ID NO: 147887 - DNA, 740 bp, Homo sapiens
  misc_feature: GYAE6OF02FGIRB.26.67.G01.1.454.CMB.1.raw
  modified_base (185)..(185): a, c, t, g, unknown or other
  misc_feature (185)..(185): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctcgcacagtctctgacggcctcctatgacgctgacacacgcccacccgtcggtntcagtcgtcccaggacaacggcaggactacacctgccgtccgganagtcgctattacgaaaccaaaaaattntacgtactttaagttcggtaccaagtaccgaaggtaacggtcgaacggtcccgacggtccccgtagtcgtcgttgtacctacgtccgtaggacggacacgacgacggaccgaccccgtccggactcccgtgacgtagtacttccgtcgtcggccttaccgacggttacgaacgggacgtaacggtcggtaccctcgtttacgtacggttcggtcggtaacgggggtccgggtacccggaagggggtttcgggaaacggtacggtacggaaacggtcggtaaccgtaacgttacccgttacgttacgttaacctaacgaaggttaacgacggttaaggttaggttacgtacgttacgtacgggttgggttcgggtacgggaacgggtacggacgtacgtcgtacgtacccggtggtaccggtcacggtaacccgcggtacccgcccggtacccgttccggctaccgtccgttcccgttaccccg

SEQ ID NO: 147888 - DNA, 944 bp, Homo sapiens
  misc_feature: GYAE6OF02G6IOF.26.67.G01.1.454.CMB.1.raw
tcagagactatactcacgaccggtgctcgatttagagtatacatattgggtttgggggggctcaggaggcagagctctgggaatctcaccatggcctggacccctctcctgctccccctcctcactttctgcacagtctctgacggcctcctatgagctgacacacgcccacccttcgggtgtctacgtccgtccccaaggaccgaaaccggccgaaggactcacctgccgtaccggagatgactattacgaaaacctaaaaaatcgtagtacttacgttcggtaaccagacgtaagaagtcgacgcccgacggccccgttgtcgcgtacggtctagtaccgtaaggacggtacgacggtacggaccgtaacccggtacccccggtaccgggtaccttacccggtaggtaacggtagttaaccgttttccgaccggttccggttaccgttaccggttaacggttaaccgggaaacgggtaacccgtaaacggttcccggtaaacccgtttaccgttaccgtaagttccggttaaccggtacggggttcccgggggaacccgtttaagggggtacggggtaaggtaaccgggttaacgggaccggttaacggttaaccgttaaaaccttacccggttaaccgttttacgtaaacccgttaccgtaaaccgaagttaacggttaggtttaacggtttacggtttaccggttaccggttaaggggttttccggggttacggggtttaccgggggacccggggtaaacccgggttaccgtaaccgggttaccgtaccgggttaccccggtttacgggtttaccgggcccggtaaacccggttacccgggacgtttaccccccggggtaccccggtttaccccccggaccgggtttttacccttaccccgggttccccggtttccccgtaaccccccgttttaccccgg

SEQ ID NO: 147889 - DNA, 747 bp, Homo sapiens
  misc_feature: GYAE6OF02HV41P.26.67.G01.1.454.CMB.1.raw
tcagagactatactcacgaccggtgctcgatttagagtatacatattggggtttgggggggctcaggaggcagagctctgggaatctcaccatgcctggaccctctcctgctccccctcctctactttctgccacgagtctcgtgagccctcctatgagcctgacacacgccacccgtggtgtcaggtcgtaccccgaggaaccgaaaaccggtccaagggtactaccgtaccttcggccgttaccgggagacttcgcctaattacgaaaccctaaaaaaattcgtagtacttaagttacggtaccgagtacgaagtaacgtacgacgtaccgacgtccccgtagcgtccgtaggtctaaacgtcttaacggacggtacgaacgcgacgaaccggtacccggtacccggtacttcggtaaggacggtacggtattccgtggtaccgtccgtaccgttaggtacgaacgggtaacaaacggcggtacccctagtttaccagtcggtcacggggttacggccgtaaggtcggaagtacggttagacgatccgtacgtacgtactaacgttacacgaaacgtagaactaggtacgttaagtcggactaggtttcgggtacgtacgggtacgacggtaacgtcgtaccgttacgaccgggttacgtcgggaaccgaccggttacccggaaccgtccgtacccggttcccgtacgggttccctaacggtccgttacccgttacccggtaccc

SEQ ID NO: 147890 - DNA, 839 bp, Homo sapiens
  misc_feature: GYAE6OF02I2KRY.26.67.G01.1.454.CMB.1.raw
tcagagactatactcacgaccggtgctcgatttagagtatacatattgggtttgggggggctcaggaggcagagctctgggaatctcaccatggcctggaccctctcctgcctccccctctcactttctgcacagtctcgtggacgcctctagtgacgctacgacacgacgtccctacctcgtactagtccgacggttaccgtacccgaaggaaacccgaaaccggccgaacggtactacctaccgtccgtccgtaccgggagtacgtcgaccgtaacgttaaccgaaaacctaaaaattcgtacgttactttaggttaaccgtacgacgagtaacgacgtaccggacgaccgacccgtccgtacgtcgtcgacgttacgtaactccggaaggtacgaacgtaccgaccgaacccggaccccggttaccccggtaccggaccgtttacccgaggtaacgtacggttaccttcggttaaccgccggttcctaaccggtacgttacgggacgtaactacggtacccgtaccgtacgttaaccggtcttaccgggtacggtaccgggggttaccgggacccggttaaggggacgggtacggtaaaggtaaccgtacgtaacgtaaccggtaactaccgtttaccggttacttaaaccggctaaaaccggtacgtacggtttaaggtcggttacgttaaccgtcccggtaagggtttcggtacgggtacccgggacggaaccggttacggtaacgtcccggtaccgttcgtaacggtccgacggtaccgaccgtaccgtcccgtaccgtcccggttacgcccttacgtcccgtaccctcccgg

SEQ ID NO: 147891 - DNA, 802 bp, Homo sapiens
  misc_feature: GYAE6OF02FU2S6.26.67.G01.1.454.CMB.1.raw
  modified_base (108)..(108): a, c, t, g, unknown or other
  misc_feature (108)..(108): n is a, c, g, or t
  modified_base (250)..(250): a, c, t, g, unknown or other
  misc_feature (250)..(250): n is a, c, g, or t
tcagagactatactcacgaccggtgctcgatttagagtatacatattgggtttgggggtgggctcaggaggcagagctctgggaatctcaccatggcctggacccctntcctgctccccctcctaactttctgcacagtctctgaggcctcctatgagctgacacagcccacctcggtgtcagtcgtccccaaggacaaaccggccaggactcacctgctccggagactgctagttcgaaccaaaaaatntgtacttagttaggtaccagacaagaagtcaggccacggtcccctagtcgcgtggtacacttaccgtaacggaacgggacacggtaccgaacggaaccgtaccccgtccgggtacttacccgtacggaacgtaacgttacgtcgttaccgttcggaccttaccgtaacggttccgaaacggggtctaaaacggtccgggtaacccgtaaccgttcggaacccggtttagaccgggtacgggtaccgggggtacccggtaggggttacgggaaggtacgtacgggtaagtccgttaacgaacgttaccgttaacgttacgttaacgaccgtaaacgaccggtaatacgggttacgttacgtaacgttcgtacgggttgggttaccggtacgggacgggtaaccgggtaaccgtaagttccggtaccggttaccggtaccgttaccggggttaacctaacccgggtaccgtaaccgggttcccgttcccgggtaccccgttacggggttaccacccgggttttacccgttacccggttaacccccttaccccgg

SEQ ID NO: 147892 - DNA, 791 bp, Homo sapiens
  misc_feature: GYAE6OF02H0U5Q.26.67.G01.1.454.CMB.1.raw
  modified_base (278)..(278): a, c, t, g, unknown or other
  misc_feature (278)..(278): n is a, c, g, or t
  modified_base (478)..(478): a, c, t, g, unknown or other
  misc_feature (478)..(478): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctcgtgacggcctcctatgagctgacacacgcccacccgtcggtgtcgtagttcgcccccaaggaaccaaaaccggccgaaggtactccaccgttcgcgtccggacgtagcgctaagttacgaaaacctaaaaaaatnttggtactttaagttcggtaaccaagcgaaagaacggtcgaacggccgaccggtccctgtcgcgtgtctactcgtaacggaggcgatccgacgtaccggaccccgtcgggaactccgagagagtaccttgtcgtacgtcctacgtacgttacggacggactacggtacgtcccgtacgttacggtaccgtggttaaccgngggttccggggacctacgggggagggtaacgggtacgttaggaaacgttcggtaacggtacccttaaggttaacctttaacgttaccgtaacgtaaaccgtaaggtaactaacgggttggtttaaacggtaccgttacgggtttaacgtcggggttttaccgggtacggggttcggggtaaacccgggtaacgtaacgggtcggtacccgggttaaccgggttccggtaacgggtttaaccgcccggttaccgaccggtccggtacccccggttccgacccgttaccgtcccgttccgttccccgttaccccg

SEQ ID NO: 147893 - DNA, 809 bp, Homo sapiens
  misc_feature: GYAE6OF02JO6GB.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagcccaccctcggtcgtcagtcgtccccaggacgaaaccggccaggactccaccgtgcctaccggagtatcgactaagttacgaaacctaaaaaaatgtatacctttagtacggtaccagtaccaagtaacgtaccgaggcccgacggccccttggcgtccttcggtacctacgttacggacggaacggtaccaaggaccgaacggtaaccccggtaccccggttaccgggaacctttcccggagaacggtaacggttctttccgtacggttcggacccttccgtaaggtttaccggaagggtaacctaacgtaccgggtacctaccggttacgtacgttcgtacggtacgggtccgggcgtacgggtggaaagtcgtacggagtacgtaacgtaccgttacgttcgttaatacccgacgtaaacgtacgaacgttaggttaaggttccgttaaacgtcggtttaaacggggttggggtttccggttaacgggggtaccggtaaaccggttaaccgacgggtacgttacccgggtaccggttaccgggtccgggtaacccgtcggaaaccccgggtgtaacccccggttccggtacccccggttccgttcccgtaaccggtttccgttacccccggttcccgg

SEQ ID NO: 147894 - DNA, 762 bp, Homo sapiens
  misc_feature: GYAE6OF02FNCW3.26.67.G01.1.454.CMB.1.raw
  modified_base (260)..(260): a, c, t, g, unknown or other
  misc_feature (260)..(260): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctggaggcctcctatgagctgacacacgccacccgtcggtgtcagtcgtccccgaggacaacggccgaggactcacctgccgtccggagacgtgctagttacgaaacctaaaaaattntacgtacttagttacggtaaccagacgaaggtaacggtccggaacgggcccgtaaccgggtcccccgttaggttcggtccggtttcgggtacctaacggtcccgttaacgggacggaaccgtacgaccggtaaccggaacccggtacccccgggtaccggggtaaccttccccggtaaggacggtacgttacgtttcgtaccgtcggtccctacggtacgttacggacggacgtaacgtccggaccttacgttcggaccgttcgacggtacgggtccggggaccgtaggggtacggacggtagtacgagtcgtagtacctacgttacttacgtactaccgtaacgacgtatacggttagttacggtactcggtacggttgggtacgtcgggaacggacgaacgtacgtcgtcggtacccgttcgggtacggaccggacgacccggtagtcccgttacccggtcccgttccggtacctcccgttaccgttcccggtacccccg

SEQ ID NO: 147895 - DNA, 773 bp, Homo sapiens
  misc_feature: GYAE6OF02F8N83.26.67.G01.1.454.CMB.1.raw
tcagagactatactcacgaccggtgctcgatttagagtatacatattgggtttggggggtgggctcaggaggcagagctctgggaatctcaccatggcctggacccctctcctgctcccctcctcacttctgcacagtctctgaggcctcctatgagctagacacagccacccgtcggtgtcagtcgtcccgaggaccaaacggcaggactcacctgaccgtaccggagatgacctacgttacgaacctaaaaaatcgtgtacctttaggttacggtacctagccgtaagaacgttacgacgtaccgaaccgtcccgtacggtcggaccgttacggtacctaactaccggttacggaacggtaactacggacggaaccgtacccgacccgggttacccggtaaccgtacccgtagggtaacgtaacggtactttaccgtccgttacggtccgacgttacgttaccggaaggtaaccgtaacggtccggaacccttaaccggttcgacggttacgtaccggtaggtccggggtaccgtagggtacgggtagacgttagaaacggcgtaacgtactaacgtttacgtacggtacttacgaactacggtaacgtgttacgttaggtactaccggtacggttaggttcggaccggacgggtacggtaaccgtaacgttcggtccggtaaccggttcggacgggtaccgttaccggaccgaaccggttccgaaccgttccccgtacggtaaccgtccgttccgacccgttccccccgg

SEQ ID NO: 147896 - DNA, 644 bp, Homo sapiens
  misc_feature: GYAE6OF02I6M18.26.67.G01.1.454.CMB.1.raw
  modified_base (145)..(145): a, c, t, g, unknown or other
  misc_feature (145)..(145): n is a, c, g, or t
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
tcagagactatactcacgaccggtgctcgatttagagtatacatattgggtttgggggtgggctcaggaggcagagctctgggaatctcaccatggcctggacccctctcctgcctcccctcctcactttctgcacagtctctgnggcctcctatgagctgacacagccaccctcggtgtcagtcgccccaggaaccaaacgggccaggatcacctgtacnccggagatgctatagacctaaaaaaatntgtacttagttacgtacgagacgaagtaacgtacgacgaccgaccggtccgtaggtgacgtcgtacacgtacgtacgacggtacgagacgaacgaccggtacccggtacggtacctccggaggtaacgtaactacgttcgtacgtacgcctacgtaggtacggaaggtaactaacgtcgtacctacgttgtacgtcgtacgacgggtaccgggaccgtaggaggagtagtagtagctacgactactatacgtacaactaacgaagacgtagtagtagttacgtacgtaggttggtacggtacgggacgtaacggacacgtcgacgtaccgtcggtacggtacgacggaccgtacgccgtaccgtcccgtacgtacgtaccgttaccgccgtcccg

SEQ ID NO: 147897 - DNA, 739 bp, Homo sapiens
  misc_feature: GYAE6OF02FUW2B.26.67.G01.1.454.CMB.1.raw
  modified_base (248)..(248): a, c, t, g, unknown or other
  misc_feature (248)..(248): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgcctccggagatgcattacgaacctaaaaaaatntacgtcttagttcggtaccagacaagaacgtcacggccacggcccctgtcgctaggtcatcgtacgaggacagcaaggaccgacccgtccggacttcccgaggacgtacgtactttcctacgtcggctaccgtaggttacgacgggtaacagtccgccctacgttcgaaccgttcgtaccgagggttccgggaccggtacgggttagggaggtaacggtaggaacggtacgtggtaacctaccgttacgtttacttaacctaaccaacgtacgtaccgtaagggttagttacgtttaactccggtaacggtttcggggttcggttccggggtaacgggtaaccggggtaacccgtaacggtccgggttaccgggtaacccgttccgggtccgggttaaccggaaccggtaccccgtaaacgggtcccgtttaccccggacccccggtttacgccccgttaacccgtttacccgttccccggttccccccgg

SEQ ID NO: 147898 - DNA, 756 bp, Homo sapiens
  misc_feature: GYAE6OF02F9R7E.26.67.G01.1.454.CMB.1.raw
  modified_base (266)..(266): a, c, t, g, unknown or other
  misc_feature (266)..(266): n is a, c, g, or t
  modified_base (354)..(354): a, c, t, g, unknown or other
  misc_feature (354)..(354): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacacgccacccgtcggtgtcagtcgtaccccaggaaccaaacggccgaggactccaccgtcgccgtaccggagacgtcgctaagttacgaaaccaaaaaaatntgtactttagttacggtaaccacgacaaggaacgtcgacggtccgaccggtcccctaggtcgacgtggtctagtacgtacggaggacnggaccacgtaccgacccgtacgggactcccgtagagtacgtacttccttcgtacggcctacgtagtacgacgggaacaacgtcgggaccctacgttacgacgttcggtacgtacgggtcggggaccgtaggggtacgggaaggtagtaacgggtacgtcgttacgtaaaccttaccgttaggttacgttacccgttacaaacgacgtaaccgtaggttaacggtttacggttacttaccggttacgggtttaggggttccgggttaccggggaaccgggtaaacggaacccgtgggtaccggtccgtacccgggttcggttacggtacccggaccgtacccggaacggtcccgttacccggccccgttacggacccttcccgtttcccgacccggttccccc

SEQ ID NO: 147899 - DNA, 769 bp, Homo sapiens
  misc_feature: GYAE6OF02F4095.26.67.G01.1.454.CMB.1.raw
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (372)..(372): a, c, t, g, unknown or other
  misc_feature (372)..(372): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctggaggcctcctatgagctgacacngccacctcggtntcngtcgtcccaggacaacggcaggatcactgcgtcganatgcattcgaacctaaaaaatntgtactttagttacggacctagcgaaggtaacgtcgaaggtccgacggcccccgttggtcgcgttaggtacacgttacgtaccggagggaaccagtaccaacggaccgtacccgttccggggaccttaccgnggaaacgtagttacgttaccttcggtccggtaccgttaccgtacggtttacggacggacctaggtccggtaccctaacccgtttaggccgtttacgggtactacgggggtccgggacccgtaagggggttcggaagggtacggttaagaccggtacgtagttaaccgtaacttaacggttactaccgttaaccgacgttaacgagtaacgggttagttacgttacgttaccggtaacgtttcgggtttacgggttaccgggaacggttacgggttaaacccacggggttacctcggtaaccccgttgggttaccgggtaccgtaacccgtaccggtaaccggccgttacccgttccccggtacgtacccgcgtttcccggtaccgttaacccccccg

SEQ ID NO: 147900 - DNA, 1041 bp, Homo sapiens
  misc_feature: GYAE6OF02HT552.26.67.G01.1.454.CMB.1.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgacggcctctatgagctgacacagcccacccgtcggtgtcagtcgtccccaggaccaaaccggtccgaggactccaccttcgcctccgggagatganacttagaaaccgtaaaaaaaatntagacctttagttacggtaccagcgaacgaaggtccgaacgggcctaacgggcccccgttagtacggtccgttacggttcaacgtttaccgtacgggaaccggaacacggaccaacggaaccccgtacccccgtaccggggtaacctcccccggtagaaccggttaagtacgtttacccgtaccggtttacggggtaccctacccgttaacggtttaccggaaacggggttaccgtaaaacggtttcccgggtaccccgttaaacccgttttcgggtaaaccgttacgggtttacccgttaacggggggtttacccgggggttaacccgggtaacggggggtttaaccgggtaaggggtaaacggtttacgggtaaacggtccggttaccggtaaccgttttaaacccgttaaccggtttaaaccgttttaaccggtttaaccgaaaaccggtttaacccgggtaaaccgttaacggggtttttaaacgggtttaacgttttaacccgggtaacgttttaccgggggttttaacggggggtttccggggttttaacccgggggttaaccgggggaaacccgggtaaacccgggtttaaaccgggacccggttttaaccgggttacccccccggtttaacccggttacccggttaaaccccggaaaccggttaacccccgggttaaacccgggaccggtttacccccggaccccccccggtttgggtaaacccccgttttaccccggttccccgtttaccggttttaaccccccccccg

SEQ ID NO: 147901 - DNA, 756 bp, Homo sapiens
  misc_feature: GYAE6OF02J24Y5.26.67.G01.1.454.CMB.1.raw
  modified_base (246)..(246): a, c, t, g, unknown or other
  misc_feature (246)..(246): n is a, c, g, or t
tcagagactatactcacgaccggtgctcgatttagagtatacatattgggtttgggggtgggctcaggaggcagagctctgggaatctcaccatggcctggacccctctcctgctcccctcctcactttctgcacagtctctgaggcctcctattgagctgacacagccaccctcggtgtcagtgtccccaggacaaacggccaggatcacctgctcccggagatcgctattgacctaaaaaaatntacgtcttattggtaccagccagaagttcaggccaggcccctgtgctggtcactctacgagtaccagccagtaccgacccgtcgggactccccgtgacggagacgtttcctcgtcgggtcctacccgtacggtttccgaacggggacctaaacgtcgggtaccctaacccgttacgtaccgttacgttaccgaagggttcccggggtacccctaaggggttccgggaaacgggttaacgtacggtaaaacggttcccgttaacgggtaaccttaaccgttaaccgttacggtttaaccgttaccgaaacgtaaccgtaccggtaaggtttaacgtcgggtttaactaccgtttaaaccgggttggggttaaccgtttcgggggaaccggttaacgggaacccgttaaagggccttaccggacggtttccgtaaccgggttcgaaccggacccctaagggcccttaccgtccccggttacgtaccctaccggttccgtaccggtttccccc

SEQ ID NO: 147902 - DNA, 812 bp, Homo sapiens
  misc_feature: GYAE6OF02FR5OR.26.67.G01.1.454.CMB.1.raw
  modified_base (252)..(252): a, c, t, g, unknown or other
  misc_feature (252)..(252): n is a, c, g, or t
  modified_base (406)..(406): a, c, t, g, unknown or other
  misc_feature (406)..(406): n is a, c, g, or t
tcagagactatactcacgaccggtgctcgatttagagtatacatattgggtttggggggggctcaggaggcagagctctgggaatctcaccatggcctggacccctctcctgctccccctcctcactttctgcacagtctctgacggcctcctatgagctgacacagcccacccgtcggtgtcagtcgtccccgaggacaaacggccaggactcacctgcctccggagatgcagttacgaaccaaaaaaatntgtacttagttcgggtaaccagccaaggaacgtccgaacgggtcccaacggcccccttggtcggtctcgggtctacgttctaaccggaggtaaccaggacaacggacccgacccgtccgggactcccgtgacggatacttcgttcgtcggtccnccgtaagttccgaagggtacaaagttccgggacccttaccgttacggtaccttcgggtaccgtacggggtccgggggtaccccgtaggggtacgggaggggtaattacgggaacgtccgtacggtaaccgttaaccgttaacgttacggtttaaactaccgaaaccgaacgtaacgtacggtttagggttaggtttaacgtaccgtacggtttcgggggttacgggtttaccggggaacggggtaaccgggtaaaccggtaacgtacccggtaccggggttacccggttaccgggtaccggggtttaccggaaccggttaaccccggaaccgggttcccgttaccccggtccccgttaccggttaccgttacccgttcgttccccgggttccccgttaccccccgg

SEQ ID NO: 147903 - DNA, 727 bp, Homo sapiens
  misc_feature: GYAE6OF02HHW33.26.67.G01.1.454.CMB.1.raw
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaatntgcttattcggtaccagtcaggaagtcgaaggccaggcccctgtgctggtcatctacggagtacagcacggaccgaccctcgggactcccgtgaacgagtacttctacgtggacctccgtaaggttccgagggaacctaacgttacggaccccttaccgttacggaacttcggtacgtaacgggtcggggaccccgtagggttccgggaaggtacgtaggaaaccgtcgacggtaaccgtaccgttaacgttacggttaactaccgtaaagtaacggtacgtaacggttacggttaaggtttactacgtacggtttacggggtcggtttacggggaccggggaacgggtaaccccgaagggttaccgtacggtacccggtttacccgggttacgggtaacccgtaacgggacccttaacgggcccggttaacccggccccccggttacgggtacccctaccggttaccgttcccggttaacccccc

SEQ ID NO: 147904 - DNA, 811 bp, Homo sapiens
  misc_feature: GYAE6OF02HAV4X.26.67.G01.1.454.CMB.1.raw
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccacccttggtgtcagtcgtcccaggacaaacggccaggatcacgtgcgtccgganatgcattacgaaaccaaaaaaaatntagactttagttacggtaaccagtacaaggaagtacgaacgggaccaacgggtcccccgttaggtcgcgttcgggtacactaccggttaacggacggtacacggaccgtacggacccgtaccccggtaccgggtaccttcccgtaggaacgtaacgtctttccgtacggttcggtaccctacgtacggttacgaacgggtaacctaacggtccgggtacctaccgttacgtacgttcggtaccggtaacggtccggggtacccgtaggggtacgggaggtaggtacgacggcgtacgtaaccttactaacgtttcgttaaacctacgtaaacgacgtaacgacggtttaacggttacggtttaactacgtacgggttacgggttcgggttacggggtaccgggtacgggtaaacccggtagttacccgggtcggtaccggtttaccgggtcggggttaacccgaaccggggtccccgtaaaggggttccccggtacccgggttacccccgttaccggtttccccgtaacccgttcccgggtttcccccgtttacccccccgg

SEQ ID NO: 147905 - DNA, 731 bp, Homo sapiens
  misc_feature: GYAE6OF02IK20H.26.67.G01.1.454.CMB.1.raw
  modified_base (183)..(183): a, c, t, g, unknown or other
  misc_feature (183)..(183): n is a, c, g, or t
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
tcagagactatactcacgaccggtgctcgatttagagtatacatattgggtttgggggtggctcaggaggcagagctctgggaatctcaccatggcctggacccctctcctgcctcccccctcctcactttctgcacagtctctgacggcctcctatgagctgacacacgcccaccctcggtntcagtcgtcccaggaaccaaaccggccaggactccacctgcgtccggagatgacagttacgaaaacctaaaaaaatntgtacttagtacggtacagcaagaacgtcgacgccgaccgccctgtgtctcggtncgtctacggacgagacgacacgccgtacccgtcggaccttccgagacgcgtacttcgtcgtcggtaccttcgaacgttcggaacggtacaaggtccggtacctaccgttacgtaccgtagtaccggtagggtacccggggacccgtaaggggtcgggtaaggtacgtaggtaacgtcgtactaccgttaaactcgttaaacgttacgaaccgaacgtaaccgtacgtagtttacggttacggtttactaaccggtagggtttcgggggttaccgggtacgggtaaccggggtaacggaaccccgtaggtacccggttccgtacccgggtacgggtacggtacccggaccgtacccggtaaccgtccccgtccgtaccccggttcgtaccctacccgtttccggtcccgttaccccg

SEQ ID NO: 147906 - DNA, 756 bp, Homo sapiens
  misc_feature: GYAE6OF02JG0YX.26.67.G01.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagagactatactcacgaccggtgctcgatttagagtatacatattgggtttgggggtgggctcaggaggcagagctctgggaatctcaccatggcctggacccctctcctgctcccctcctcactttctgcacagtctctgaggcctcctatgagctgacacagccaccctcggtgtcagtcgtccccaggacaaacggccaggatcacctgctccggagntgcatgacctaaaaaatntgcttattcggacctagacagaagtcgaggccacggcccctgtacgcgtggttaccagttcctaacggacgggtaccaggtccaacggacccgaccccgttccggggacctccccggtaggacgtacgtacgtttccgtcgtacggccgttaccgtaggttacggaccgggtaaactacgtaccgggtacctaccgttacggtacgttcgtaccggtacggggttaccggggaccccgtaagggggtccgggaaaggggtacgttaacgggaacgtcgttaccggtaaaccgttaccttacggtttacgttaaccttaaccgaacgtaacgtaccgtaggttaacggtgttacgttaccgtaggttacgggttcgggttacggtacgggacggtaccgtacgggtccgtacgggttaccgtcggtcgggtacctacggtacccggaaccggtcccggttaccggtcccccgttcccgggttaaccttacccggttccgttacccggttcccccgg

SEQ ID NO: 147907 - DNA, 714 bp, Homo sapiens
  misc_feature: GYAE6OF02F8N4N.26.67.G01.1.454.CMB.1.raw
  modified_base (252)..(252): a, c, t, g, unknown or other
  misc_feature (252)..(252): n is a, c, g, or t
  modified_base (367)..(367): a, c, t, g, unknown or other
  misc_feature (367)..(367): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacagtctctgaggcctcctatgagctgacacagccaccctcggtgtcagtcgtcccccaggaccaaacggccaggactcacctgccgtccggagatcgcattcgaaccaaaaaaatntagtacttagttacggtaccagtcaagaagtcgaggtcccacggcccctggtcgcgttggtactacgtactaacggaggtaccagcgaacgaccgacccgtccgggactccccgngtaagacgtattccgtcgtcggtcctccgtacggtttcggaacgggtaacaaacggtcgggtaccctaaccgtttgaacctttggaccgtacggggttaccggggccccgtaaggggttagggaacgggtaagtaggaacggtaccgtagtaaccgttaaacgttacttacggttaacctacgaaacacgacgtagttaaggtggttaactgtacgttggggtacgttcggggacgtaacgggtaccagccgtacggtaccggttcggtcgggaccaccggtaccccgaagggttccctcccggtacccccggttcgaccgtccgttaccgttcccgttacccccgg

SEQ ID NO: 147908 - DNA, 751 bp, Homo sapiens
  misc_feature: GYAE6OF02IWNA5.26.67.G01.1.454.CMB.1.raw
tcagagactatactcacgaccggtgctcgatttagagtatacatattgggtttgggggtgggctcaggaggcagagctcgtgggaatctcaccatggcctggacccctctcctgcctccccctcctctactttctgcacagtctctgacggcctcctagtgagctacgacacacgcccacccgtcggtgtacacgtcgtacccgaggtaaaccgaaaccggaccgaaggactaccaccgtacgccgtccggagtacgtcgactacgtacgaaaacctaaaaaatgtagtacttagtacgtaacagagaagaagtacgacggaccgaccggtcccgtaggtactcgtaggtacactacgtacggagacagacgaacgacccgcccgtacggtctacctaggaagactacgttcagtcgtctacgtacggttacggaggaactaggtccgtaaccgtacgtagtacgtacgtacgtacggggtaccgggccgttaagggaggtaacgtacggttaagaacggtcgtaaaccgtaacgttaacttacggttaacttaacgtaaccgaacgtacggtaacggtacgttacggttaacgtttacgacggtttagggtaccgggttacggttaccgggaacgtaaacggaaacccgtagtcccacggttaccgtcgggtaaccgtcggaaccgaccggtccggtacctacccgggtacccgttaggtacctacccgtttaccgtccccgtaaccccg

SEQ ID NO: 147909 - DNA, 792 bp, Homo sapiens
  misc_feature: GYAE6OF02GE9CY.26.67.G01.1.454.CMB.1.raw
  modified_base (452)..(452): a, c, t, g, unknown or other
  misc_feature (452)..(452): n is a, c, g, or t
  modified_base (591)..(591): a, c, t, g, unknown or other
  misc_feature (591)..(591): n is a, c, g, or t
tcagagactatactcacgaccggtgctcgatttagagtatacatattgggtttgggggtggggctcaggaggcagagctctgggaatctcaccatggcctggacccctctcctgcctccccctcctcctactttctcgcacagtctctgacggcctcctagtgagctagacacacgcccaccctcggtgtcagtcgtccccgaggaccaaaccggccgaaggtactacctaccgtcgccgtaccgggagtaactcggcctaagttaccgaaaacctaaaaaaaattacgtacgttatttaacgttacggttaaaccgaggtaaccaaaggaacgttacggaaccggacccgtaccggtaccccgttcggtacggtcgtacggtacacgttacggtaaccggacgaacgacgtaccgaaccggaccggtaccccgaccgggtacttaccccgnggtaagacggtacgttccttccggtcggtaccgtacgtaccgggttaccgtaacgggaacgtacggtaaccgccgttaaccgtcgtacttggaccggtagggtcccgggacggtacgggtggggaagtgtaacggtaancgtagtacccgttacgttagttactaaccgtagaaacgtagtaccgtaggtaggttgtacgtacgtacggttcgggtcgttacggggaacggtcggaaccgtagtaccgtacgtccgtacggttccgaacgaccggtacccgtaggacccgggttccctacccggaccgttacccgcgttccccggtcccgttacccccgg

SEQ ID NO: 147910 - DNA, 778 bp, Homo sapiens
  misc_feature: GYAE6OF02IIBND.26.67.G01.1.454.CMB.1.raw
  modified_base (244)..(244): a, c, t, g, unknown or other
  misc_feature (244)..(244): n is a, c, g, or t
tcagagactatactcacgaccggtgctcgatttagagtatacatattggggtttgggggtgggctcaggaggcagagctctgggaatctcaccatggcctggacccctctcctgctcccctcctcactttctgcacagtctctgaggcctcctatgagctgacacagccaccctcggtgtcagtcgtcccaggacaaacggccaggatcactgctccggagatcgcagttgaaccaaaaaaatntagtactttattggtaccagcaagaacgtcacggccacggcccctgtcgctcggtcacgttacgtacgacggacagcaagaccgtacccgtacgggactacccgtaggaagacgtaactttcgcgtacggccttaccgtacgttcgaacgggtaactaacgttcgggaccctaacgttacggacgttcgtacggaacggttccggggaccctaggggtagggaaggtacgttagggaaacgttcgtacgaaccgttaacgtacgttacggtaaccttacgaaacgtacgaacgtaaggttacggttaccgggtttaacgttacggtaaccgttcgggggtttcgttaaccgggggtaccgggtaaccggaaacccggttaaggtacccggtacgggtaaccccggtttccgggtaacggggttacccaacccggggtttaacccggaagggtaccccggtttaccccgggtaccccccgttacgggtttaaccccgtaccggttttaccccgttaccccggttttaaccccccg

SEQ ID NO: 147911 - DNA, 743 bp, Homo sapiens
  misc_feature: GYAE6OF02H5LVU.26.67.G01.1.454.CMB.1.raw
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
tcagagactatactcacgaccggtgctcgatttagagtatacatattgggtttgggggtgggctcaggaggcagagctctgggaatctcaccatggcctggacccctctcctgctccccctcctcactttctgcacagtctctgaggcctcctatgagctgacacagcccacccgtcggtgtcagtcgtcccgaggaccaaacggccaggancacctgctaccggagatgctattagaaaccaaaaaaaatntagtactttattacggtaccaagtaccaagaagtacgacggacccgacggtcccctggtcgtcgtggtcactacgtacggaaggacgagtaccaacgacccgaccccgtacgggaactcccgtagagtagtcttcgtcgtcggtactccgtaggttacgacgggtaactaaggtccgtaccgtaacgttcgaccgttcggtacgtacgggtcggggtaccccggtaaggggtacgggtaagggtaacgtagggtaaacgtcggttaaacgtaacgttaaccgttaaccgttacggttaaccgtaacaaaccgtacgtaacgtaaggttacggttacgtttaacgtcgtaacgggttgggttacgggtacggggtacggtacgggaaccgtaggtaccgtacgggtccgtaccggtcggtaccgaccggacccggtaacgtcccggacccgttcccggtccgtaccgttaccgttcccgttccgtacccccg

SEQ ID NO: 147912 - DNA, 907 bp, Homo sapiens
  misc_feature: GYAE6OF02GB2U3.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacacgtcctctgaggccctcctatggagctgacacacgaccctacccgtcggtgtacacgttccgtacccgaggaaccaaaccggccaaggaacttccgaacccgtgtaccgtaccgggaagtactacgactacgttacgaaaacctaaaaaaattcgtacgtacgttttagttacgggtaaccaaggacgtaaggtaaccgtacgaaccgggtccgaccgggtcccctggtacgtcgtcggtacacggttacgtaaccggaacggacaggtacgaccgacccggtcccgtaccggacctccggtagaacggtactacttccgtcggtcgtaccgtacgttacggttaccggaaagggtacctacggtaccgtacccgttaacgtttacccgggagtttaccgggtaccgggtacgggggtacccgggtacccgggtacggggtaacggggaaacgggtaacgtttaaggaacccggttcgttaaacccggttaacgtttaacccgtttaaccgggttaaccgttaacctaaccggaaaccggtaacgttaaaccgggttacgggttaaggtttaaccggttagttacccggtaacggggtttcgggggttacccgggttaaccgggggaacgggttaaaccggacctaaccggggttcccggttacgtacccgggttcgggtaaccgtaaccggtacccggtaacccggtacggtcccgtaccccgtccccgttaccggtaccctcccgttacccgttcccttacccccgg

SEQ ID NO: 147913 - DNA, 1004 bp, Homo sapiens
  misc_feature: GYAE6OF02IDXVI.26.67.G01.1.454.CMB.1.raw
tcagagactatactcacgaccggtgctcgatttagagtatacatattgggtttgggggtgggctcaggaggcagagctctgggaatctcaccatggcctggacccctcctcctgcctccccctcctcctactttctcgcacagtctctgacggcctcctatggagctcgaccacacgccctacccgttcgggtcgttcacggttcggtacccccgaaggaaccgaaaccgggccgtaaaggaaccttaaaccgtcgcccgtacgggacgtacgtcggacttaacttaaacggaaaacctaaaaaaaagttcgttaacgtttaccgtttaggtttaaccgggtaaacctacggacgaaaacggtaaacggttaccgaaccgggtaacccgaacccggttccccggtttacggtcccggtaccggttacggttacctaacggtaaccggttaacggaccggttaaaccgacgggaccgaacccggtaacccgtaaacccccgggttcccggtaacccgttacccggtaacggggtaaacgaaccgggtttacgttaacctttaccggtccggtaccgttaacccgggttaaccggtttaccggaaaccggggttaaaccaaacggtttcccgggtaccccgttaaacgtttccgggtaaaccgtttccggtaaccgggtttacgggggtcccgggggtaccccggtaggggtacggggtaacggtaacggtacgggaacgttaaccggttacgtaaaccgttaccgttaacgttacggttaacctaaacgaaccggtaacgtaacggttaggtacggttacggttaccgtacgtttacgggttacggggtccggtttacggggaaccgggtaaggtaaacccgacggttaccgtacccgggtcggtttaccgggcggaaccggaccggtaccgtaaccggcccggttaccggttcccggtaccggttaaccggttccgtacccgtttccccgtaccccgttacccg

SEQ ID NO: 147914 - DNA, 941 bp, Homo sapiens
  misc_feature: GYAE6OF02JTZ86.26.67.G01.1.454.CMB.1.raw
  modified_base (311)..(311): a, c, t, g, unknown or other
  misc_feature (311)..(311): n is a, c, g, or t
tcagagactatactcacgaccggtgctcgatttagagtatacatattgggtttgggggggctcaggaggcagagctctgggaatctcaccatggcctggacccctctcctgctccccctcctcactttctgcacagtctctgaggcctcctatgagctgacacacgcccacccgtcggttagtcgaacgtccgtaccccgaaggaaccgaaaaccggcccgaaggtaacttacccgtaacccgtcggtaccgttaccgggaagtaacgttcggacctaagtttaccggaaaaacccgttaaaaaaaaagtnttaacggttaccttttaacgttacgggtaaaccccgagtaaccgaaaggtaaggtaccgttaaccgggaccccgtaacgggtaccccgttgttccggtcttacggtacgtaacgtacccgtaacggaacgtacgaacggtaaccgaacggtaaccccggtaaccccggtcccggtaaccgtcccgtagggaacgtaaacgttccggtcttaccggtacggttaacctaccggttacgtaacgggtaacggtaaacccgaggttaccggtaccgttaacccggttagttaaccggtaccggtccgggtttagggaccccgggggttaccggtaacggggttaagggtaacgggttcgtaaaggtacccgggtaacgtaccgggttaaccttaacccgggtagtttaacccgttacgtaaacaaaccgtaaccggttaagaacggtttaagttagttaccgttacggacggtttacgggtaccgggttaccgggaagggttaaccggaacgggttaacggtaccgtaccgggttacgttccgggtacggtaaccgggtccgaccggtaacggccgttaccccggttcgtacccggttactcccggttccgttacccgttcccccggtaaccc

SEQ ID NO: 147915 - DNA, 780 bp, Homo sapiens
  misc_feature: GYAE6OF02IH4CQ.26.67.G01.1.454.CMB.1.raw
  modified_base (189)..(189): a, c, t, g, unknown or other
  misc_feature (189)..(189): n is a, c, g, or t
  modified_base (292)..(292): a, c, t, g, unknown or other
  misc_feature (292)..(292): n is a, c, g, or t
tcagagactatactcacgaccggtgctcgatttagagtatacatattgggtttgggggtgggctcaggaggcagagctctgggaatctcaccatggcctggacccctctcctgcctccccctcctcactttctgcacgagttctctggacggcctcctatggagctgacacacgcccaccgtggtctanacggtccgtacccgagggaaccgaaaccggccgtaggactaccgaccgtacgtccgtccgggaagtacgtcgtacgttaataacgaaaacctaaaaaaagttntcgtaccgttagttaccgtacgacgtacgaaggtaacgccggacggacccgacgggtcccgtggtaccgtcggttcgtactacgttcggtaacgggaagacgaccgacgaaccggtcccgacccgggtcggtaccgtcgtaagacgtacttacgttcgtacggacggtcctaacgcggttaacggaaacggtcgaacggttccggaactttaccgttcggtaccgttggtaccgggtcgggtacggggtcggtagggagggtagcgtaggaacgtcgtcgttaaacgtccgttacgtacgttaacgactacggtacgtagttaagggttcgtaacgttacgtcggtaggttggggttaccggtaaggggccgggtaaggacccgtacgggtccgggtaccgtcggtaccgggtaggtaccggaccggacccggtcggtaccccgtccggtcccgtaccggtcttacccgtcccggttacccgtccccg

SEQ ID NO: 147916 - DNA, 740 bp, Homo sapiens
  misc_feature: GYAE6OF02JOMID.26.67.G01.1.454.CMB.1.raw
  modified_base (375)..(375): a, c, t, g, unknown or other
  misc_feature (375)..(375): n is a, c, g, or t
  modified_base (446)..(446): a, c, t, g, unknown or other
  misc_feature (446)..(446): n is a, c, g, or t
  modified_base (492)..(492): a, c, t, g, unknown or other
  misc_feature (492)..(492): n is a, c, g, or t
  modified_base (581)..(581): a, c, t, g, unknown or other
  misc_feature (581)..(581): n is a, c, g, or t
tcagagactatactcacgaccggtgctcgatttagagtatacatattgggtttgggggtgggctcaggaggcagagctctgggaatctcaccatggcctggaccctctcctgcctcccctcctcactttctgcacagtctcgtgacggcctcctatgcgctgacacacgcccacccgtcggtcgtacgtcgtcgtacccgaaggaaccaacgggaccgaaggtactccaccgtcgtccggtaccggagtacgttacgactaacgttaacgaaaaccttaaaaaaagttctcggttacttaacggtttccggaactacgacgaacggtaacgtacgacggaccgacggttccccgtaggtcgtcggtacgttaccngtaccgtaacggacgacgacgtacgaccgaaccggtccccgtagacccgtcgtacgagacgttctacgtcncggtcctacgacgttacgacggtacgactcgggcccttacgtacgngttaccggacggttacggggcggtacgacggtagggtacgtacgagtacgttcgtacgacgttaacgtcgttacgttaacacgggtaanacggttaacgtcgttaggtaacgttgccgttacgggttgggtaccgggtacgggtacgggacgtaacgacgtcccggtacgtccggtacggtcggacctaacggccggttacgcccgtacccgtcccgtaggttcccctcgttccccgtcccgttcccg

SEQ ID NO: 147917 - DNA, 695 bp, Homo sapiens
  misc_feature: GYAE6OF02GC942.26.67.G01.1.454.CMB.1.raw
  modified_base (239)..(239): a, c, t, g, unknown or other
  misc_feature (239)..(239): n is a, c, g, or t
  modified_base (415)..(415): a, c, t, g, unknown or other
  misc_feature (415)..(415): n is a, c, g, or t
  modified_base (469)..(469): a, c, t, g, unknown or other
  misc_feature (469)..(469): n is a, c, g, or t
tcagagactatactcacgaccggtgctcgatttagagtatacatattgggtttggggggggctcaggaggcagagctctgggaatctcaccatggcctggaccctctcctgctccccctcctcactttctgcacagtctctgaggcctctatgagctgacacacgccacccgtcggtgtcagtcgtcccaggacaaacgccagatcactgctcggagatgctatacgaaccaaaaaatntacgtacttattacggtaccagacaagtagtacgacggccacggcccctggtcgcgttcggtactacgtacgtaaccggaggacacggcacggaccgacccgtcgggacctccgagagacgtacttcgcgtcgccgtacgtacggttacgacgggtactaaggtcgaccctacgtnaccgtcgtacgacgggtacggggccggtagggtacgggaggtagtaggaacgtntacggtacttactacgttacgttaacctacgaactaacggaccgtaggttacggttacggttactacggtcggttacggggttcggtaccggggacgggtacgggaaccgtagtccgtaccggtaccggttaccggtcgggtaccgaaccggtacccggtaacggccggttaccccggtcccgttaccgggtccttacccttcccggttacccgtccccttacccg

SEQ ID NO: 147918 - DNA, 742 bp, Homo sapiens
  misc_feature: GYAE6OF02FZ3US.26.67.G01.1.454.CMB.1.raw
  modified_base (234)..(234): a, c, t, g, unknown or other
  misc_feature (234)..(234): n is a, c, g, or t
tcagagactatactcacgaccggtgctcgatttagagtatacatattggggtttgggggggctcaggaggcagagctctgggaatctcaccatggcctggacccctctcctgctccccctcctcactttctgcacagtctctgacggcctcctatgagctgacacacgcccaccctcgggtctcagtcgtccccgaggaccaaaccggccaggactcacctgccgtccggagangacctattacgaaccaaaaaaatcgtgtacctttaagttacggtaaccagaccgaaggaacgtaccgacggcccgaccgggtcccccgttggtcggtccgttgggtcaacgtcggtaacggaggaacaggacacggacccgtaccccggtccggggtacctcccgtaggacgagtactttccgtcgtacggtctacccgtagttccggaacgggtaacacggtcggaccctacgttcgtaacgtcgtacgcgggtcgggaccggtagggtggaggtagtcggagtccgtacgtaaccgtacgtacgttacgttacgtaccaacgtaacgtaacgtagttagggttacgttcgtacggtacgggtttcggggttacggtcggggaccggggtaacggaaccggtaaccgtcgaccggttaccggtccggtcgggtaccgaccggtaccggtaacggtcccgtcccgtccccgttaccggtcctacccgttccggtccctaccctacccg

SEQ ID NO: 147919 - DNA, 955 bp, Homo sapiens
  misc_feature: GYAE6OF02INM50.26.67.G01.1.454.CMB.1.raw
  modified_base (295)..(295): a, c, t, g, unknown or other
  misc_feature (295)..(295): n is a, c, g, or t
tcagagactatactcacgaccggtgctcgatttagagtatacatattgggttggggggctcaggaggcagcatcggaggtgcctcagccatggcatggatccctctcttcctccggcgtccttgcttactgcacaggatccgtggcccttcgatgacgtcgtgtattcgacgccctaaccctcgacgttacgttcccgtcgtaccccccgaagggtaccaacgaaccacggacccaaaccacgttccacccgtcggaccgtccgggaccaacgaaaccgtaaaagttcggggaanaacgtaaggaaaactcgaccgttacgaccgtaggttaaccttaacccgaggtaaccggccccggaacggtcccgtaacccgtttccccccgtttaagttttttcgggtacctaacgttacccgtttaaacccgaaaggtaacgtaaacggtaaccggacccgggtaccctacggtaaccggggtaccttaaccccgtacgggtaacccgttaacgtttcccgtcggtaccctacccgtaacgttccgtaaggaacccgactacgaccgttaccttacgacggtacccaacggtccgaacggggaccccggggacccccaacggaccccgtaacgggtaccgtacggggtaacgggtaacgttaccgtacggttttaaccgtacgggtaacccggtagggggtacccggtaagggggtaacgtaaaacggtttaaccggttaagttttaaccgggttaggtttacggggtttcggggtaaccggggtacgggtaaacccgtcgggtaacccggtacgggttaccccgtacccggtttaacgggtccgtaacccggccccggttaaaccgggccccgtttaaccccggccccgggtttaacccggtaccctaaccggttccccgtttacccggtcccccgttccccgttacccgttaacccg

SEQ ID NO: 147920 - DNA, 832 bp, Homo sapiens
  misc_feature: GYAE6OF02JAC7B.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctcactttctgcacagtctctgacggcctcctatgagctgacacacgccaccctcggtgtcagtcgtcccaggacaaacggcaggactccaccgtgcgtaccggagatgctattacgaaaccctaaaaaaatcgttacgtacgttttagttcggttaaccgaacgtaccaacgggtaagttacgaaccgggcccgtaaaccgggccccccgttaggtcggtcgtacgggtacctacgttaccgttaccgggacggaacgtacgccgtaacggaccccggtaacccgtccgggacctaccccgttggactaaacggtccttttacctaccggttcgtaaccgtccgttacgttccggaaacggggtaaccagttcccggtacgtacccgttacgtaacgttcgtacgggaccggggttccggggccgaggggttacgggtaagggactttaggaacgtcgttacggtaaccttacttaccggtttactaacgtaccgtaaacacggtaacgtaagggttacgtttacgggttacctcgttacggggttcgggtttacccgggttacgggaccggggtaaaccggtaactacgggttccgttaccgggaccgtttcccgggtttaggggaccctacgggaaccccggttcgggtacccgttacccggtccccggttagtcccggtaccgtttcccacccggtttacccccg

SEQ ID NO: 147921 - DNA, 791 bp, Homo sapiens
  misc_feature: GYAE6OF02HDM0T.26.67.G01.1.454.CMB.1.raw
  modified_base (290)..(290): a, c, t, g, unknown or other
  misc_feature (290)..(290): n is a, c, g, or t
  modified_base (420)..(420): a, c, t, g, unknown or other
  misc_feature (420)..(420): n is a, c, g, or t
tcagagactatactcacgaccggtgctcgatttagagtatacatattgggtttgggggtgggctcaggaggcagagctctgggaatctcaccagtggcctggacccctctccctggcctccccctcctcactttctgcacacgtctctgacggcctcctatgagctgacacagcccacctcggtcgtcagtcgtcccaggacctaaacggccaaggactccacctgcgtccggaggtatcgctagtaacaaaacctaaaaaaagtgtactacttacgttacgactagtanacgaaggtcgacgtccgaccgcccgtagtcggtacctgggtaccagtaccggtaaaggacggtaaccggacggaccgaacggacccgacccggttacggaccttaccggagtacaggtcttctaggttcnccttaacgtagttaccggaaggtacctaacggcgtacctcttacggtacttacggtcgttaccggggtacgggaccgttaggggccgggtaagtaacggcggtaaacgtctaacgggtaacttaaaccgttcggttaactttaaccgttacgaaacggtacgtaacggtaagttttaccgggacggttaacgtacggggtttcggttacgggttaccgggagggaaccgtaacggttaaccgaggggttccccgacgggttccccgaaggttaacccggcccgggaaacgttccccgggtaccccgtacccgggtacccttaccggtaaccccgggtttccctccccggggttacctaccccgttacccgg

SEQ ID NO: 147922 - DNA, 999 bp, Homo sapiens
  misc_feature: GYAE6OF02H8TQW.26.67.G01.1.454.CMB.1.raw
tcagagactatactcacgaccggtgctcgatttagagtatacatattgggtttgggggtgggctcaggaggcagagctctgggaatctcaccatggcctggacccctctcctgcctccccctcctctactttctgcacagtctctgacggcctacctatgagctgacacacgcccacccgttcggtgtcctacggtcgtacccccgaggaaccgaaaccgggccgaagggtacttaccgaccgtacgtccggtaccgggagtacgtggccttaacgtttaaccggaaaaaacctaaaaaaaagttcgtacggttacgttttaagtaccggttaaccgaagtaccgaaggtaacgtcccggaacggacccgaccggtcccgtggtacgtcggtcgttactcgttacgtacggaacgaacgaacggaacgacccgtaccggtcgggtacctccgtaaggacgtacgttacgttcgtcggttcggtacccttacggtacgtaccgaacgggtaactaaggtcccggttaacctacgttcgtacggtcgtacggtacgggggttacccggggaccgtaagggggtacggtaacggtacggttaacggaacgtttccggaacgttaacccggttttaacccggttaaccgtttaaaccgggtttaacccctaaacggtaaaccggttaaaccgggtaaccggtttaaaggggttttaaccggttaaacggttttacccggtaaccggtttaaccgggggtttgggggtttaacccggggttccggggtaaaaccgggggttaaacccggggaaaccttccggggttaacgttccccgggttaacccgggtttcccgggggtaaccggttaacccggggtaacccccgggttaaccggtaaacccggggttccccgttaaccccccggggttccccgtttaaccgggtttacccccgtttaccccggtttccccggtttacccccgttccccccgttaaccccgg

SEQ ID NO: 147923 - DNA, 786 bp, Homo sapiens
  misc_feature: GYAE6OF02FQ8KD.26.67.G01.1.454.CMB.1.raw
tcagagactatactcacgaccggtgctcgatttagagtatacatattgggtttgggggtgggctcaggaggcagagctctgggaatctcaccatggcctggacccctctcctgctccccctcctcactttctgcacagtctctgacggcctcctatgagctgacacagccacccgtcggtgtcagtcgtcccaggaccaaacggccaggactcaccgtgccgtccggagactgactagttacggaaaccaaaaaaattgtacgtactttaagttcggtaaccagtccaaggtaacgtcaacgggcccgaacggtcccctgtcgcttcggactacgtactaggaacggtacacggcgtacggccgtaccccggtacgggaccttacccgtaggacggtacgttacgtccgttcgtacggtcctacgtacggtttacggaggtaacacgtacggtacccttacgttcgtacgtcgtcggaggggtccgggtaccggagggttagggaacggtagttaacgggaacgtcgttaaggtaccctaacggttacgttacgtttactacgaaccgtagtaaccggtaggtttacggttacgttaattccggtacggtttacgggtacgggtttaccggggacccgggacggttaaccgaccgggtttcgttacccgggtaccggttccggttaacggggtaacctacccggtaaccggttccggtaccccgtcccggtttacccccggtaccggttacccctaccggtttccccgtttacccgttaccccccc

SEQ ID NO: 147924 - DNA, 517 bp, Homo sapiens
  misc_feature: GYAE6OF01CEOQS.47.87.H10.1.454.CMB.1.raw
  modified_base (256)..(256): a, c, t, g, unknown or other
  misc_feature (256)..(256): n is a, c, g, or t
  modified_base (490)..(517): a, c, t, g, unknown or other
  misc_feature (490)..(517): n is a, c, g, or t
tcagagctcacgtacacgaccggtgctcgatttagcagtactgcgttgggtttggggaggccttgagtggctgggaaggacatactacaggtccgactggaaaagtgattatgcagaatctatgcagagccgcataaccatcactgcagacacatccaggaaccagttctccctacaactgaactctgtgactcccgaggacacggctatatattactgtgtaagagtccgtcacctgggacaggggtttttaccncgtgggccgacggacctggtctccgtctcctcacgcctccaccgaacggccctacgtccggtcccttcccccgtcggcccgtcccgtcgcctaccgacggacgaccgtacccgtccggacgacgaccaacgacggccggcccgtgggcctcggccgtcggtacgaacggtaccttaccgttccgtacgtcgacgtcgtcgtggacggcgggtcgtggacgaacggcgacatagnnnnnnnnnnnnnnnnnnnnnnnnnnnn

SEQ ID NO: 147925 - DNA, 540 bp, Homo sapiens
  misc_feature: GYAE6OF01ERBXG.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctatttggcttttaatccgggcctccgggtccctgactaggttcactggcagtggatcaggcacagtatttacattagaaattcagcagagtaggagctggacgatgcgtaggtagttttaatacgtgactagtgacaaagactaaaaccgaacttcctttacacccgttcgaccgtaaggggaccacggtactacgggaacagttaacggaacgtaaccgtggtcggctacg

SEQ ID NO: 147926 - DNA, 431 bp, Homo sapiens
  misc_feature: GYAE6OF01C7EVE.47.87.H10.1.454.CMB.1.raw
  modified_base (423)..(431): a, c, t, g, unknown or other
  misc_feature (423)..(431): n is a, c, g, or t
tcagagctcacgtacacgaccggtgctcgatttagcagtactgcgttgggtttgggaggccttgagtggctgggaaggacatactacaggtccgactggaaaagtgattatgcagaatctatgcagagccgcataaccatcactgcagacacatccaggaaccagttctccctacaactgaactctgtgactccgaggacacggctatatattactgtgtaagagtccgtcacctgggactaggggttttacctccgtggggccagggaaccctggtctccgtctcctcagcctccaccaaggcccatcggtcttcccctggcgccctgctccaggacgcacctccgagagcacagcggccctgggctgcctggtcaaggctacttcctacgtgagctctgagcggctggcaaggcgcatagnnnnnnnnn

SEQ ID NO: 147927 - DNA, 577 bp, Homo sapiens
  misc_feature: GYAE6OF01EAQVB.47.87.H10.1.454.CMB.1.raw
tcagagctcacgtacacgaccggtgctcgatttagcagtactgcgttgggtttggggactgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactctgatctatttggcttttaatcgggcctccggggtccctgacaggttcacgtggcagtggatcgaggcacagtattttacattagaaatcagcagagtgggagctgacgatgcgttgggtagtttattacgtgactattagacaagtacctaaaacctaaaccttcccttttaccaacccgttttacccgggaacccgtaaacggggaaccctaaccggaaccgttacggtaaccgtaagtttaacggaaaccgtaacgttggtagggtacccg

SEQ ID NO: 147928 - DNA, 514 bp, Homo sapiens
  misc_feature: GYAE6OF01CVFHE.47.87.H10.1.454.CMB.1.raw
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccggggtccctgacaggttcactggcagtggatcaggcacagtattttacattagaaatcgagtagggtggaggctgaggagttggttggggtttattacgtgctatgacaagttctaactaaacttcctactacgtttggccgagggaccagctggagatacaaacgactgtggctgcacctatctntcttcntccc

SEQ ID NO: 147929 - DNA, 673 bp, Homo sapiens
  misc_feature: GYAE6OF01ANKP4.47.87.H10.1.454.CMB.1.raw
tcagagctcacgtacacgaccggtgctcgatttagcagtactgcgttgggtttgggctcagttcaccttctcacaatgaggctccctgctcagctccgtggggctgctaatgctctgggtctctggatccagtgggatattgtgatgactcagtctccagtcctccctgcccgtcatcgttggagacgcccggcctccatcctcctgcaggtctagccagcgccctcctgcagactaagtaggaaatacctagtttggattcggtacctgacaaaacgccgaggcagtcctaccaactaacctcctagtacttcttagtttcggtacttttaacggccgggtcccgttcccggggtccctgacgtacggttccacgtggactaggtgtactcgaggcaacgtagttattttacgaagtttaacgaaaactcgaagtacgaaggtaggtacgggacggtacgtacggaacgtagtcggtacgttagggttaacgttttacgttacgtgtacgtagtacgaactaaacggtaaccttaaaacctaacccgtttccctttaccgtaacccgttaccggaaccgtaaacgggacctaacgtaccgtacggtaaccgtagttaacggacgtaaccgttggtacggtacctacgacccgtaccttacgttccgttaccg

SEQ ID NO: 147930 - DNA, 576 bp, Homo sapiens
  misc_feature: GYAE6OF01BTO08.47.87.H10.1.454.CMB.1.raw
  modified_base (300)..(300): a, c, t, g, unknown or other
  misc_feature (300)..(300): n is a, c, g, or t
  modified_base (432)..(432): a, c, t, g, unknown or other
  misc_feature (432)..(432): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgtggagagccgcctccatctcctgcaggtctagccagagcctcctgcagaactaatggaaatacctatttggattggtacctgacaaaagccaggcagtctcacactccngatctatttgactttaagcggcctccgggtcctgactaggttcacgtggcagtggatcgaggcacagtatttacattagaaatcagacagagtggagtctaggacgtatgcgttaggtagttttaattacgngactaagtcgaccgtaaagtaacctaaaacctaaaccttcccgtttaccgacccgtttaccggaccgaaacgggtaccaacggtaaccgtacggtaaacctaacgtttaaacggaaccgtaaagttcgggtaggtccgttaccg

SEQ ID NO: 147931 - DNA, 550 bp, Homo sapiens
  misc_feature: GYAE6OF01C5G3S.47.87.H10.1.454.CMB.1.raw
  modified_base (294)..(294): a, c, t, g, unknown or other
  misc_feature (294)..(294): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgcctcctgcagactaatggaaatacctatttggattggtacctgacaaaagccgaggcagtcnccacaactcctgattctagtttcggtacttttaacgcgggtccgtccggggtccctggactacggtttcacgtggctaggtgactcgaggcactagtatttacattagaaatcagcagagtggagctagacgatgctaggtatttattacgtgactagtgacaacgtaactaaactaacttcctttaccaccgttccggaccgaacgggaccacggtactacggtaactagttaacgacgtaacgtggtcgctacg

SEQ ID NO: 147932 - DNA, 518 bp, Homo sapiens
  misc_feature: GYAE6OF01D6GQR.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatcttatttggtcttttaagcgggtcctccgggtccctgacaggttcacgtggcagtggatcgaggcaacagtattttacatttagaaatcagcaggagtggagctgacgatgctggtagtttatactgcatgacaagactaaacaacttccttacaccgttcggaccgaaggacacgtacgtagactaacgttagaacgtatcgtggctacg

SEQ ID NO: 147933 - DNA, 561 bp, Homo sapiens
  misc_feature: GYAE6OF01ELP0M.47.87.H10.1.454.CMB.1.raw
  modified_base (188)..(188): a, c, t, g, unknown or other
  misc_feature (188)..(188): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtnatcgttggagagccggcctccatctcctgcaggtctagccagacgcctcctgcagactaataggaaatacctattggattggtacctgacaaaagccaggcagtctccacactcctgtatcttattgtacttttaagtccgggtccgtccgggtcctgacgtggttcacgtggcaggtggatcgaggcactagttattttaacatttaagaaattcgaagacaggtaggtaggaggtctagacgtatgcgtaggtagtttatactgactagtagacaagactaaacctaaccttacctttaccgtaccgttacggaccgaacgggaaccaacgtacgtacggactaagttaggaacctaagtggtcgcgtacg

SEQ ID NO: 147934 - DNA, 573 bp, Homo sapiens
  misc_feature: GYAE6OF01ED2O8.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatcctcctgcaggtctagccagacgcctcctgcagactaataggaaataccttatttggattggtacctgacgaaaacgccgagggcagtcctccacaactcctgtatcttatttggtacttttaagtccgggtccgtccgggtcctgacgtaggttcacgtggcagtgatcgaggcactagtatttacattagaaatcgagcgagaggtggacggtctagacgtagtcggacgttagggttaatttaagtacgttgacgtagtacgaacaacgtacctaaaacgtaaccttccttacctaccgttcggaaccgaagggtacctacggacgtaggaactaagttacgacgtaatcggtgcgtacg

SEQ ID NO: 147935 - DNA, 600 bp, Homo sapiens
  misc_feature: GYAE6OF01BSG0G.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgccctgggtctctggatccagtggggatattgtgatgactcagtctccagtctccctgcccgtcatcgttggagacgccggcctccatctcctgcaggtctagccagacgcctcctgcagactaatggaaataccttatttggattggtacctgacaaaagccgagggcagtctccacaactcctgatctatttgtacttttaagcgggtcccttccggggtccctgacgtaggttcacgtggcaggtggatcgaggcacgtagtattttacattagaaatcgagcagagtggaggctaggacgtagtcggtacgttagggttaattttactacgtgacgtaattcgaacgtaaacgtaaccttaaaacctaacctttccctttaaccgtacccgtttaccgggacccaaacgggtaccaaccggtacgtaggaacctaagttaacggaacgtaacgtggtacgctacgacctaactattcgtcgttacc

SEQ ID NO: 147936 - DNA, 506 bp, Homo sapiens
  misc_feature: GYAE6OF01D1TOD.47.87.H10.1.454.CMB.1.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatgaaatacctattgattgtactgacaaagcaggcagtctcacactctnatctattgtactttancggcctccgggtcctgacaggttcacgtggcagtgatcgagcacagtatttacattagaaatcagcagagtggagctagacgatgctggtatttatactgacatgacaagactaaactaacttccttacaccgttacggaccgaaagggaccacggtacgtacggaactaagttacgaacgaattggtgtcgtacg

SEQ ID NO: 147937 - DNA, 721 bp, Homo sapiens
  misc_feature: GYAE6OF01CNDR6.47.87.H10.1.454.CMB.1.raw
tcagagctcacgtacacgaccggtgctcgatttagcagtactgcgttgggtttgggggtgatcaggactcctcagttcaccttctcacaatgaggctcccctgctcagctcctggggctgctaatgctctgggtctctggatccaggtggggatattgtgatgactcagtctccgagtcctccctgcccgtcatcgtggagcgccggcctcatctcctgctaggtctagccagacgcctcctgccaagaactaagtaggtaaactaccttagttaggtattacggtacctagaccgaaaacgccgagggactacgtcctaccaactacctctgtacttcttagtttggtacttttaacgccgggtcccgttcccgggtcctaggaccgtaggttcctaacgtcggacgtaggtcgggaacgtcggaggtacccaacgtaagttaacttttaacgtatttaacgaaactcgaacgacgtaaggaacgggtacgggtaggtaccggttaagggtaaccgtaggttacgggtacggtttaaggttaacgtttttaacgtacgtacggtaccgtaaggtaccgtaaccgtaaacggtaaccttaaacccgttaacccttcccgtttaaccctacccggttaccggaacccgtaaaccgggtaccctaaccggtaacgttacgaaacttacgtaacggaaccgtaggtacggtccggtcgtaaccg

SEQ ID NO: 147938 - DNA, 585 bp, Homo sapiens
  misc_feature: GYAE6OF01ECT8X.47.87.H10.1.454.CMB.1.raw
  modified_base (302)..(302): a, c, t, g, unknown or other
  misc_feature (302)..(302): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagacgcccggcctccatcctcctgcaggtctagccagacgcctcctgcagactaataggaaattaccttatttggattggtacctgacaaaagccagggcagtccnccacaactctgatcttatttgtacttttaagccgggtccgtccgggtccctgactaggttcacgtggctaggtgactcgaggcaacgtagtattttacattagaaatcagcagagtggagctagacgtagtgtacgttaggtaagttttatacgtgactagttagaactaagtaacctaaaaccctaaccttccctttaccgtacccgttaccggaacccgaaacgggtaccaaccggtactacggaactaacgttaacggaacgtaacgtggtcgcgtaccg

SEQ ID NO: 147939 - DNA, 592 bp, Homo sapiens
  misc_feature: GYAE6OF01B216N.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgcctcctgcagactaatggaaatacctatttggattggtacctgacaaaagccgagggcagtcctccacaactcctgatatatttggcttttaagtcgggccgtccgggtccctgactaggttcacgtggcagtggatcgaggcacagtattttacgactagaaatcgaggtagggtgggaggtcgtggaggtagttggtttaggggtttatttacgtgctagtgacgtaacgttacttaactaacctttaccctacttaccgttttcgggacccgtacggggtaccctaaggtccgtagggtaagacgtaaccgaaaccgtaacgttggtacggtacctaggaccctaaccgtgttaccg

SEQ ID NO: 147940 - DNA, 800 bp, Homo sapiens
  misc_feature: GYAE6OF01EEEHW.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctccgtggggctgctaatgctcgtgggtctctggatccaggtggggatattgtgatgactcagtctccagtcctccttcgcccgtcagttcggttggagacgccggcctccatcctctgcaggtctacgccagacgccctcctgacagaacttaagtaggtaaaacttaccttagtttaggtagtttacgggtaaccctagaaccgtaaaacgccgtaagggcctaacgttccctacccaacctaaccgttccgtagtactttacgtttagttttacggttaccttttaacggtcccggggttcccgttcccggggtcccttaggacccgttacggttcgacgttcgggtacctagggtaggtacgtacggaacggtacccgtaacgttaagtttaactttttaacgtaaagtttaacgtaaaaacgttccggaaggtaacgtaacggggtagggttacgggacgggtaccgttaaggaaccggttagttacgggttacggtttagggttaagttttaactttacggtagtacgtagttacgtaaccgtaaacgtaaacccgtaaaaccttaaccgtttaccctttaccgtaacccggtttaccggaacccggtaaacgggtaaccctaacggtaccgtaaacggtaacgtaaacggttaccgaaacggttacggttcggtacggtcgtacccg

SEQ ID NO: 147941 - DNA, 667 bp, Homo sapiens
  misc_feature: GYAE6OF01EBRYT.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtcctccctgcccgtcatcgttggagacgcccggcctccatctcctgcaggtctagccagacgccctcctgcagactaagtggaaattacctatttggattggtacctgacaaagccagggctagtcctaccactaacctcctagtacttcttagttttcggtactttttaacgcccgggtccgtcccgggtcctgacgtacggttcagtggcaggtgactcgagcacgtagttactttacgactaagtaaactcgtaggtagggtaggacggtacgtaggtacggttagtttgggtttagggtttaattacggtgtacgtagtacgtacgttaacgttacctaaccgttaacctttaccgttaacgttaccggttttacgggaacccggtaacgggtaaccgtaacggtcggtaaggtaacgtaacgtaaccgtaaacggtacgttagggtacggtccgtaccggacctaccgttacttaccttagttaccttccgtaccttccccg

SEQ ID NO: 147942 - DNA, 569 bp, Homo sapiens
  misc_feature: GYAE6OF01DEI23.47.87.H10.1.454.CMB.1.raw
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (558)..(558): a, c, t, g, unknown or other
  misc_feature (558)..(558): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccattctcctgcaggtctagccagacgcctcctgcagaactaatggaaaactacctatttggtattcggtacctagacaaaacgccgaaggcagtcctccaacaaccttcctagtacttcttatttcggtacttttaagccgggtccttccgggtccctagactggttcacgtggcagtggatcgagcanagtattttacattagaaatcagcaagaggtggagntagacgntgcgttaggtattttattagtgactatacgacaagtaacctaaacgtaacctttcccttaccacccgttcggaaccgtaaacgggactaacgactacggaactacgttacggaactacgnggttgcgtacg

SEQ ID NO: 147943 - DNA, 559 bp, Homo sapiens
  misc_feature: GYAE6OF01BUZQT.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgcctctgcagactaatggaaatacctattggattggtacctgacaaaagccgagggcagtctaccactaacctcctgacttcttatttggtactttttaacgtccggggtcccgttccggggtccctggacctaggttccacgtggctaggtggatcgaggcatagtatttacattagaaactcagacaggtagtggagcgtgacgagtcggtacgtaggtatttattacgtagctagtgactaacgtactaaactaaccttccttacgaccgtacggaccgaacggtacacggtactaggaactacgttaacgacgaatgagctacg

SEQ ID NO: 147944 - DNA, 567 bp, Homo sapiens
  misc_feature: GYAE6OF01ENS8D.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagacgccgcctccatcctcctgcaggtctagccagacgcctcctgcagaactaataggaaatacctattggattggtacctgacaaagcgaggcagtcaccacaactcctgatcttattgtactttagccggccgtccgggtcctgactaggttcacgtggcagtgatcgaggcactagtatttacattagaaatcagcagagtggagctagacgtatgtcgttaggtatttatacgtagacgtagtcgaactaaacgtaaccttaaaactacctttaccttaccgacccgttacggaaccgtaaacgggacctaaccggtacgtacggtaactaacgttaacggaacgttaacgttcggtcggtcgtacg

SEQ ID NO: 147945 - DNA, 634 bp, Homo sapiens
  misc_feature: GYAE6OF01CUL01.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccaggtggggatattgtgatgactcagtctccagtcctccctgcccgtcatcgtggagcgccgcctccatctcctgcaggtctagccagacgcctcctgcagaactaataggaaaacttaccttatttggattcggtacctgacaaaagccgagggcagtcctccaacactcctgtattctagtttggtacttttaacgtccgggtcccgttccggggtcctggactggttccacgtggcgtaggtgtatcgaggacacgtagtattttaacattaacgaaatcagacgaaggtaggtaggaggtcgtaggacgtagtcggtacgttagggttaagttttactacgtgactagtcgacgtaaacgtaacctaaactaaccctttccctttaccgtaacccgttacgggaacccgtaaacggggtaccctaaccggtacgttacgggaaacttaacggttaaccggaacgtaacggttggtccgggtcctaccgg

SEQ ID NO: 147946 - DNA, 546 bp, Homo sapiens
  misc_feature: GYAE6OF01AN4XR.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgcctcctgcagactaatggaaatacctatttggattggtacctgacaaaagccgagggcagtcctccacaactcctgatctatttggcttttaagtcgggtcctccgggtccctgacaggttcacgtggcagtggatcgaggcacagtatttacattagaaatcagcagagtggagctgacgatgtcgtggtagtttatacgtgctagtgacaagtacctaaactaaccttcctttacgacccgttaccggaaccgtaacgggaccaacggtacgtaggaactaacgttacgaccgtaaagtggtcggccgtacg

SEQ ID NO: 147947 - DNA, 566 bp, Homo sapiens
  misc_feature: GYAE6OF01AGXUS.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctattggattggacctgacaaaagccagggcagtctccacactctgatctatttggacttttaagcgggtcctccgggtcctgacaggttcacgtggcagtgatcaggcacagtatttacattagaaatcagtacgagtaggtgggaacgtctaggaacgagttcgacgttggtaagttttactacgtgactatagactaagaccttaaacaaccttccttaccgtaccgttaccggacccgtaaagggtacccaacggtaccgtacggtaaactaaggttacgaaccgtaaaggttggtcggtctaccgg

SEQ ID NO: 147948 - DNA, 570 bp, Homo sapiens
  misc_feature: GYAE6OF01EBTV3.47.87.H10.1.454.CMB.1.raw
  modified_base (234)..(234): a, c, t, g, unknown or other
  misc_feature (234)..(234): n is a, c, g, or t
  modified_base (389)..(389): a, c, t, g, unknown or other
  misc_feature (389)..(389): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaanggaaatacctatttggattggtacctgacaaaagccagggcagtctccacaactcctgatctatttggacttttaagcgggtcctccgggtcctgacaggtcatggcagtggatcgagcacagtatttacattagaaatcaagcagagtggaggntagacgagtgtcgtggtaagttttattacgtgcattgaacaacgacctaaaactaaccttcctttacgtaacccgttacggacccgaaaggggaaccctacggaccgttacgggaacttaagttaacggaaccgtaaacgttggtacgggtactacgtacctaacccgtattcccgttacg

SEQ ID NO: 147949 - DNA, 558 bp, Homo sapiens
  misc_feature: GYAE6OF01C8T3D.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagcccggcctccatctcctgcaggtctagccagagcctctacatagtaatggattcaacttatttgaattggtactgcagaagccagggcagtctccacagctcctgatctgtttggtctgagtcgggcctccggggtcctgacgtaggtcaggtgcgaggtggatcgagacacgagtaacttttacgactagaaactcgaaggtagggtggaggtcgtaggaggtagtttggttaggggtttattacgtgtactagtgtactaagttactaacctaacttaccttaactacgtttcggaccgtacggggacctaagccgtaggacgtaataacgtaaacgtaacgtgtcggcgtcgaccg

SEQ ID NO: 147950 - DNA, 628 bp, Homo sapiens
  misc_feature: GYAE6OF01D92O8.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagacgccggcctccatcctcctgcaggtctagccagacgcctcctgcagactaatggaaatacctattggattggtacctgacaaaagccgagggcacgtctaccacaacctcctgattcttagtttgtacttttaacgtccgggtccgtccgggtcctgacgtagttcacgtggctaggtgatcgacggcacgtagttatttaccgctaagtaaatcgtaaggtacgggtaggaggtcgtgggtaagggttagtttggggttttaggggttttaacttacggttgtacgtagtcggtaacttaacgtttaccttaaacccttaaaccttttcccgttaacttacggttttcggaccggtacggggtaccaaggtcgtggtaagtactaacgaaaacgtagtacggtcggacctaggacctccgtattcccg

SEQ ID NO: 147951 - DNA, 659 bp, Homo sapiens
  misc_feature: GYAE6OF01A8A3G.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccactcctccctcgcccgtccacccctggagacgcccggcctccatcctcctgcaggtctagccagacgcctcttaacattaagtaagtggtattactaacttatttagaatttggtacctgacaagacgccagggcacgtccaccacgagtcctctgtacttcgttggtttacgggttctggtacgtccgggtcccgttcccgggtcctaggacgtcggttcgaggtcggcgtaggtggacgtcgagcactagtacgttttacgagtaacgtaaagtcgtaagggtagggtagggaggtcgtagggagggttagtttagggtttagggttttataaggtcgtagtagtacggttactaacgttacttaaaccgttaaccgttaccttaccgttacgtttacggaccggtacggaccgtaagtacgtaggaacgtaacgtaaccggaaacgtacggttcgacgtacgtacggtacctaccgtacttcgttacgttcgttaccg

SEQ ID NO: 147952 - DNA, 658 bp, Homo sapiens
  misc_feature: GYAE6OF01CO3C1.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagacgccggcctccatctcctgcaggtctagccagcgcctctgcagactaataggaaattaccttatttggagttacggtacctgacaaaagccgagggcacgtcctaccacaactcctgtatcttagtttgtactttttaacggccgggtcccgtcccgggttccctggtaccgtacggttccacgttgggcgtaacggtggatcgacggacactagtatttaacgtattaagaaatcgaagacgaggaggtacggaggtcgtagacgtagtgcgttaggtattttacgttacgtacgtactagtacgaacgtaaacgtaaccttaaaccgtaaccctttaccctttacccgtacccggttaaccggtaacccgtaacgggtaccgaaaccggttaccggtaacgtaaccgttaacgttaaccggtaaccggtaacggttcgggttacgtaccggtaacccg

SEQ ID NO: 147953 - DNA, 523 bp, Homo sapiens
  misc_feature: GYAE6OF01E4O41.47.87.H10.1.454.CMB.1.raw
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagcccggcctccatcctcctgcaggtctagccagagcctcctgcagactaatggaaatacctatttggattggtacctgcaaaagccagggcagtctccacaactcctgatctatttgtctttaancgggcctccgggtccctgacnggttcacgtgcagtgatcaggcacagtatttacattagaaatcagcagtgtggaggtctgacgatgctaggtagtttatacgtgctagtgacaagtacctaaaaccaacctttccttacctacccgttaccggaccaaagggaccacggactggaactatacgacgaatggtggctacg

SEQ ID NO: 147954 - DNA, 858 bp, Homo sapiens
  misc_feature: GYAE6OF01EMHID.47.87.H10.1.454.CMB.1.raw
tcagagctcacgtaccacgaccggtgctcgatttagcagtactgcgttgggtttggggtgatcaggactcctcagttcaccttctcacaatgaggctccctgctcagctcctggggctgctaatgctctgggtctctggatccaggtggggatattgtgatgactcagtctccagtcctccctgccccgtcattcggttggagcgccggcctcatcctccgtgcgaggtctacgccagacgccctcctgacaaggaactaaagtaggtaaaacttaccttagtttaggatttacggtacctagaaccgaaaaacggccgaggggtaccacggttaccctacccaaactaaccttcccgtagtaactttacctttagttttacggtttaccgttttaaaccggtcccggggaccccggtttccccggggtcccttagggtaacccgttaaggttcccgtaaccggttacgggcctaacggggttgggaaacttcccggaaacgggtaccctaaagttaacggttaacttttttaaacctaacgttttaaaggaaaaaacttccgaaaggtaccggaagggttaacggggtacggggtaaggtacccgtagggtaaacgtaggttagggttaccggtttaaggggtttaatttaacggttttacaacggtccaagttaacgaccgtaaacggtaaacccttaaaaccttaacccggtttaccctttaccggaacccgttaacccggggtaaaccccggtaaagggggacccctaaacggttaaccgggttaacggaaacccgttaaaaggtttaacggaaacccgggttaaacttcgggtcccgggaaccttaaacccgg

SEQ ID NO: 147955 - DNA, 794 bp, Homo sapiens
  misc_feature: GYAE6OF01CWPCV.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtgggatattgtgatgactcagtctccagtcctccctgcccgtcatcgtggagacgccggcctccatcctcctgctaggtctacgccagacgcctcctgacaagaactaagtaggtaaaacttaccgttaagtttaggtacgtttacgggtaaccctaggaaccgaaaaacggcccggaacggggtacctaacggttccctaaccccaaaccgtaaacccgttcccgttaggtaactttaccgtttaaggttttacgggttaccgtttttaaacggtcccggggttaccccggttccccggggttaccctacggttaaccggtacggtttaccgaacggttcgggtacgtaacgggttacgggtaacttaccggaacggtaacccaaacggtttaacgtttaaacgttttttaaaccgtaagttttaaaacgtaaaaacgttaccggtaaaggtaccggtaaagggtaacgggttacgggacggtacgtacggaacgtacgttcggtaccggtttagttaacgttttacgttacgtacgtaacgtagtacgaactaaacgtaaccttaactaaccttcccttaacgtaccgttacgaccgtaacggactacggtacgtacggtataacgtacgaacgtagtgcgtcgtacg

SEQ ID NO: 147956 - DNA, 787 bp, Homo sapiens
  misc_feature: GYAE6OF01DEXV6.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctctggatcaggtgggatagttgtgatgactcagtctccagtcctccctgcccgtcagtcggttggagacgcccggcctccattctcctgcgtaggtctagccagacgcctctgacaacgaattaacgtaggtaaaacttaccttagttaggtactttacgggtaccctaggaacaaaacggccgagggacacgtccaccacgaacctcctagtacttcgttatttcggtacgttttaacgtccgggtccgttacccgggtctacggaaccgtacggtttccacggttcggacgtaaggttcgacgttacgacggtacaacgttagttaacgtttaactaagtttaaggaaaactttccgaaaggtaccgtaaagggtaacgggtacggggtacgtaccgttaagggtaacggtaacgttacgggttacggtttaacgggtttaaaggtttttaaccgtttacgtcgggtaaccgtttaaggtaaccggtaaccgttaaaaccggttaaaccttaaaacccgttaaaacccgtttttccccgtttaacccgtaaccccggtttaacggaaaccccgtaaacggggtaaaccctaccgggtacgtaaacggtacttaaacgttaacggaaccgtagttacggccggtagttacccgg

SEQ ID NO: 147957 - DNA, 630 bp, Homo sapiens
  misc_feature: GYAE6OF01BT6Y6.47.87.H10.1.454.CMB.1.raw
  modified_base (622)..(622): a, c, t, g, unknown or other
  misc_feature (622)..(622): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagagcccggcctccatctcctgcaggtctagccagacgcctcctgcagactaagtaggaaactaccttattggattggtacctgacaaaacgccgagggcacgtctaccactaacctcgtagatcttatttcggtacttttaagtccgggtccgttcccgggtccctagactaggttcacgtggctagtcgatcgaggtacactaagttactttacattaagaaattcgaagacgtagtaggtggaggtctagacgtagtcgtcgttaggttagttttaactcgtagactagtacggaactaacgtaaccttaaaactaacccgtttcccgtttaacgtaccccggtttacggaacccgtaaacgggtaacccaacggtaccgtacggtaacttaaacgttacggaaccgtaaccgtgggttccgngttacccg

SEQ ID NO: 147958 - DNA, 860 bp, Homo sapiens
  misc_feature: GYAE6OF01CQBK0.47.87.H10.1.454.CMB.1.raw
  modified_base (194)..(194): a, c, t, g, unknown or other
  misc_feature (194)..(194): n is a, c, g, or t
  modified_base (244)..(244): a, c, t, g, unknown or other
  misc_feature (244)..(244): n is a, c, g, or t
tcagagctcacgtacacgaccggtgctcgatttagcagtactgcgttgggtttggggtgatcaggactcctcagttcaccttctcacaatgaggctccctgctcagctccgtggggctgctaatgctctgggtctctggactccgaggtggggattattgtgatgactcagtctccagtcctccctcgcccgtnatcggttggagacgccgcctcatctcctgcaggtcagccagacgcctccngcaagactaagtagaaaacttaccttagtttggattacggtacctaggaaccgaaaaggcccggagggtacctacgtaccacccaacctaaccttcctagtactttacgtttacgttttcggttacgttttaaccggtcccggggttcccggttccccgggggttaccctacgggtaaccggttacggttaccgtaaccggtcgggtaccgtaacgggtcggggtaactacccggtacgggtaaacccttaacggttaacggtttttaaacgttttttaaaccgtaaaaggtttttaaacggaaaaaccgttccgtaaaacgggtaccggttaaaggggtaacgggtaacggggtacgggttaaaccgttacgggaaacggttacggtacggttaccgggtttaagggttttaacgttttaaacgtttccgtaggaccgttacgggtaacgtaaaccgtaaaacgttaaccctaaaaccgttaaacccctttcccgtttaacccggtaccccggttaacccggggaacccgttaaaccgggaacccgttaacggaaccgtttacggaaacgttaaccgtaaacgggtaaccttacggtcggtccggtacgtacccg

SEQ ID NO: 147959 - DNA, 605 bp, Homo sapiens
  misc_feature: GYAE6OF01BGBCP.47.87.H10.1.454.CMB.1.raw
  modified_base (299)..(299): a, c, t, g, unknown or other
  misc_feature (299)..(299): n is a, c, g, or t
  modified_base (426)..(426): a, c, t, g, unknown or other
  misc_feature (426)..(426): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgccctcctgcagactaagtggaaactaccttattggtattggtacctagacaaaacgccaggcagtcctaccacaactccngtactcttatttggtacttttaacgtccgggtccgtcccggggttcctgacctaggttcacgtggcaggtggatcgaggcagagtatttacattagaatcgagcagagtggagcgtagacgtatcgngttggtaagttttatacgtgtactatacgacaacgtaacctaaaacttaacctttaccttacctacccgttaccggaaccgtaacgggaacctaaccggtaacgtacggtaacttaaggttaaccggaaccgtaaacgttggtacggtcctaacgtacccaacctcgttcgtttacccg

SEQ ID NO: 147960 - DNA, 667 bp, Homo sapiens
  misc_feature: GYAE6OF01CM518.47.87.H10.1.454.CMB.1.raw
tcagagctcacgtacacgaccggtgctcgatttagcagtactgcgttgggtttggggtcgatcaggactcctcagttcaccttctcacaatgaggctccctgctcagctcctggggctgctaatgctctgggtctctggatccagtggggatattgtgatgactcagtctccagtctacctgcccgtcatcgttggagacgccggcctccatctcctgcaggtctagccagacgcctcctgcaagactaagtaggaaacttaccttagtttaggtattcggtacctgaacaaaaggccgaggcacgtacctaccaactaactcctagtacttcttagtttcgtacttttaacgtccgggtccgttcccgggtaccctagtaccgtacggttcacgtcggctaggtggtatacgagacaactacgttaattttacaagtttaacgaaaactcgaaggtacgtaaggtacggtgggacgtacgttaggaacgtgttacggtacgttaggttaacgttttacgttaccgtaggtactagttacgaactaaacgtaaccttaaacctaaccgtttcccttaccgaacccgttaccggaacccgtaacggtaccctaacggtaccgtacggtaaccttacgtaaacggaccgtaagtcggtcgtccgtaccg

SEQ ID NO: 147961 - DNA, 702 bp, Homo sapiens
  misc_feature: GYAE6OF01EUIEA.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtgggatattgtgatgactcagtctccagtctccctgcccgtcatcgttggagacgccggcctccatcctcctgcaggtctagccagacgccctcctgcagactaagtaggtaaaacttaccttagttaggatttggtacctagacaaacgccgagggacacgtcctccaacaacctcctagtactcttagtttcggttacctttttaacgtccgggtccgtcccgggttccctcggacgtaggttccgacgtcggacgtaggtacggattccgacggactacgtaggttacttttacgacttaagtaaactcggaagggttaggggtagggaggtaccgtaggggaggttagttggggtttttagggtttacttacgtgtacgtagtacgtacgttaacgtttccttaaaccgttaacctttcctaaccgtttacggtttacccggaccggtaaccggggttaaaccacggttacggtaaggtaacgtaacgttaacccgaaaacggttacgttacgggtcggaccgttaacgaacccgttacccgtagtttacccgg

SEQ ID NO: 147962 - DNA, 572 bp, Homo sapiens
  misc_feature: GYAE6OF01BDOL2.47.87.H10.1.454.CMB.1.raw
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (545)..(572): a, c, t, g, unknown or other
  misc_feature (545)..(572): n is a, c, g, or t
tcagagctcacgtacacgaccggtgctcgatttagcagtactgcgttgggtttgggaggccttgagtggctgggaaggacatactacaggtccgactggaaaagtgattatgcagaatctatgcagagccgcataaccatcactgcagacacatccaggaaccagttctccctacaactgaactctgtgacctcccgaggacacggctatatattactgtgtaagagtccgtcaccgtgggactacgggttttacctccgtggggacccgacgggaaccctggttcctccgtcctcctcacgcctacccaccgaaacgggcccacgtccggtccctttccccccgtcggcccgtcccctgtcctccacgggacgccacccgtccgagaccgccaacgacgcccgggtcccgtagggcctcggcccgtggtaccgaaacggtacccttacccgtttacccgttaccggtagtaccgtccgttccgtaggacgggtccggggtccgttcgggtaaccgaaggggtcccgacgagttaacggncnngnnnnnnnnnnnnnnnnnnnnnnnnnnnn

SEQ ID NO: 147963 - DNA, 654 bp, Homo sapiens
  misc_feature: GYAE6OF01DDV45.47.87.H10.1.454.CMB.1.raw
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (358)..(358): a, c, t, g, unknown or other
  misc_feature (358)..(358): n is a, c, g, or t
tcagagctcacgtacacgaccggtgctcgatttagcagtactgcgttgggtttgggctcagttcaccttctcacaatgaggctccctgctcagctcctgggctgctaatgctctgggtctctggatccgaggtgggatattgtgatgactcagtctccagtcctccctgcccgttnagttcgtggancgccgcctcactctcctgctaggtcctagccgagacgccttcngganagtactagtagaattacctattggattcgacctagacaaacgccgaggcacgtcctaccactaactcctagtacttctagtttggtaccttttagcccgggtccgtcccgggtcctagtaacgngttcgacgtggtactaggtggtactcaggacacgtagttaacgtttactaagttaacgaaatccgagtaccgaaggtacgtacgggacggtacgtacggaaagtcgttacggtacggtttaggttacgtttacttacgtacgtacgtagtacggtactaaacggttacgtaaaccttacccttaccgtttcgtaccgttaccgggaaccgtaaacgggaccgacgtaacggttacgaacgttaagtacgtaaccggttagcgttacgggtctacggacacccttaggtccttaccg

SEQ ID NO: 147964 - DNA, 744 bp, Homo sapiens
  misc_feature: GYAE6OF01D0BUB.47.87.H10.1.454.CMB.1.raw
  modified_base (183)..(183): a, c, t, g, unknown or other
  misc_feature (183)..(183): n is a, c, g, or t
tcagagctcacgtacacgaccggtgctcgatttagcagtactgcgttgggtttggggtgatcaggactcctcagttcaccttctcacaatgaggctccctgctcagctcctgggctgctaatgctctgggtctctggatcagtgggatattgtgatgactcagtctcagtcctcctgcccgtnatcgtggagacgccgcctcatcctcctgcaggtctagccagacgtccctccgtgacagaactaaagtacggtaaaacttaccgtttaagtttggtaagttcggtaacctagaacgtaaaacggccgaacgggctacgtcctaccaactaacctccgtagtacttctttaagtttcggttaacttttaacggtcccggggtacccgttcccggggtccttaggaacgttacggttccaacgtcggacgtaggtcgggtactacggaacgtacctaaagttaacgtttaacttttaaccgtaagtttaaacgaaacgttcgaacgtacgaagggtaggtacggggacgtacgtacggtaacgtacgttcggtacgttacgggtttaagtttacgttaacgtcgtacgtagtacgtaaacgtaactaaaccgttaaacgttaacccgtttacccgttaacccgtacccgttaccgggaaccggtaaaccgggtaacgtacccgtaacggtaacggtaacttaacggttaacgaaaccggttacggtacggtcgtacgtaacccg

SEQ ID NO: 147965 - DNA, 698 bp, Homo sapiens
  misc_feature: GYAE6OF01EZE6Y.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtgggatattgtgatgactcagtctccagtctccctgcccgtcatcggttggagacgcccggcctccatcctcctgacaggtctacgccagacgcccttccgtgaccagtactaaagtggaaattaccttagtttcggtagttcggtacctgaacaaaagccgagggctagtcctacaacacttcctagtaacgttcttaagtttcggttacttttaacgcccggggtccgttcccggggttacctggtaaaccgtcggttctaacgtgggtactaagggtcggacttaccgacggactaacgtaggttaaactttttaacgaatttaacggtaaaactcgaacgtacgaaggtaggggttacgggacggtacgtaacggtacgtacgtaggttaccggttagggtttaacgtttacttacgtcgtactagtcggaataacgtaacctaaaccgtaaccttccctttactacccgttacgaacggtaacgtacgacctaccgtagggtaacctagttaacggccttaacggtgtacggtacgttacgacctaaccgttgtaccgttcg

SEQ ID NO: 147966 - DNA, 818 bp, Homo sapiens
  misc_feature: GYAE6OF01AT8EW.47.87.H10.1.454.CMB.1.raw
tcagagctcacgtacacgaccggtgctcgatttagcagtactgcgttgggtttgggggtgatcaggactcctcagttcaccttctcacaatgaggcctccctgctcagctccgtggggctgctaatgctcgtgggtctctggactcgaggtggggatattgtgatgactcagtctccagtcctcccgtcgcccgtcagttcgtggacgacgccggcctcatcctcctgcgtaggtctacgccagcgtcctcgtgacgacgtaactaaagtaggtaaaacttaccgttagtttaggtacgtttacggtacctacggaaacaaaacggcgaacgggtaccaccgttacctaccgaactaacctcgtagtactttacttacggtttacggttaaccgttttaccggccgggtccccggttcccggggtacctacggtacgttacggttacgtacgtacgggtcgtaacggtcggtaacgtccgaagggaacctaacggtacgtttaacttttaacgtaagttaaacgtaaaacgtcgtaaacggtacggtaaagggtaacgggttacgggaacgggttacgtaacggtaaacggtagttaccgggttacggttaagggtttaacgtttaacttaacgtaacggtacgtaaacgttacgaaaacgtaacgtaaaccgttaaaacctaacccggtttaccctaaccggttacccggtaaccggtaacccggtaaacgggtcccaaacccgggttaagtaaccggtaaaccgttaacgtttaaaaccgggaacgtaaaccgggttcgttcggtaccggttaccg

SEQ ID NO: 147967 - DNA, 610 bp, Homo sapiens
  misc_feature: GYAE6OF01BBGUH.47.87.H10.1.454.CMB.1.raw
tcagagctcacgtacacgaccggtgctcgatttagcagtactgcgttgggtttggggactgatcaggactcctcagttcaccttctcacaatgaggctccctgctcagctcctggggctgctaatgctctgggtctctggatccagtggggatattgtgatgactcagtctccagtctccctgcccgtcatcgttggagagcccggcctccatcctcctgcaggtctagccagacgcctcctgcagactaatgaaattacctatttggattggtacctgacaaaagccgagggcagtctccaacactcctgattcttagtttggtcttttaacgtcgggtccgtccggggtccctggactaggttcacgtggtcgagtggactcgaggcaagtagttaacttttacaagttagaaaattcgaggtaagggtgaaggctaggaggtagttggtttaggggtttaattctgtctagtagtacgtaaacgtttccttaacctaaaccgtttccctaacgtttaccggtttacggacccggtaacggggaacctaacggtcgtaggagtaactaaccgtaaacggtactcgggtacgtacctcgacctcgtacg

SEQ ID NO: 147968 - DNA, 839 bp, Homo sapiens
  misc_feature: GYAE6OF01C5YBO.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtgggatattgtgatgactcagtcctccagtcctccctgcccgtcagtcggttggacgacgcccggcctccatcctccgtagcaggtctagaccagacgcctccgtggacacgtaaacttaaagtaggaaaacttaaccgtttagtttacggtattacgggtaacctacggaacaaaacggccgtaaagggccaacgttcctacccaacctaaccgttcctacgaacttcgttaagtttcgtaacttttaacgccgggtcccgttcccggggtccctacggtaacgttacgggttacctaaccggtaggtaccgtaagggttacgggaaattacccggaaacgggtacctaaacggttaacgggtttaaaccttttttaaaccgtaaaggttttaaaacggtaaaaaacgtttacccggaaagggtaccggttaaaagggaaacggggtttacggggaacggggttaaccggtaaggtaaaccggtaacggtttacggtaacggttagggtttaaacgttttacgttaacgtagtacgaagttacgaaccgtaaactaacctaaaccttaaaccgttaccccgtttaaccgtaacccggttacggtaaacccggaacggtaaacctaaccggtaacgtaaccggtaagttaaaccggtaaaccgaaacggtagttacggtaccggtcgtaaaccgg

SEQ ID NO: 147969 - DNA, 808 bp, Homo sapiens
  misc_feature: GYAE6OF01B4OMF.47.87.H10.1.454.CMB.1.raw
tcagagctcacgtacacgaccggtgctcgatttagcagtactgcggttgggtttgggctcagttcaccttctcacaatgaggctccctgctcagctccgtgggctgctaatgctctgggtctctgggactccgaggtggggattagttgtgatgactcagtcctccgagttcctcccgtgcccgtcagttcgttgggagtccggcccggtcctaccatccctccgtgacgtacggttctacgaccgaggtacctcccttcgacgacaagtacttaagtacgtaaacttaccgttagtttcggattacggtacctagaacaaacgccggaggtccagtccctacaaccgtacctcgtagtacttacgttagtttacggtacttttacgggccccgggtcccggttaccgggtcccctaaggtacgtacggttacctacggtcggtaccgtaggtacgtacgtacggacgtacgtacgttaaacggttttagtttaaccgttaagttaaacgtaaaccgtacgaaccggtacggtaaaccggggttagggttaacggggtaaccggtaaccggtttaacggggaaacgtttacggttaggtttaccgttaaaggggtttttacgttttaactacgggtactacgtacgtacgaaaccttaaccgtaaacccgttaaacttacccgtttaccgttccgtaacccgtacggtaaccgtacggtaaccgtacgttaaccggtaggtaaacttaaggttacgaaaccggtcggttacgacggtacctaccgtaacctacgtcgttcttacccgg

SEQ ID NO: 147970 - DNA, 744 bp, Homo sapiens
  misc_feature: GYAE6OF01CX3VL.47.87.H10.1.454.CMB.1.raw
  modified_base (267)..(267): a, c, t, g, unknown or other
  misc_feature (267)..(267): n is a, c, g, or t
tcagagctcacgtacacgaccggtgctcgatttagcagtactgcgttgggtttgggctcagttcaccttctcacaatgaggctccctgctcagctccgtgggctgctaatgctctggtctcgtggactccgaggtgggattagttgtgatgactcagtcctccacgtcctcccgtgcccgtcacgttcggttggacgacggccccggtcccttccgacttccgttcctagccgtacggttcctacggacccaaggccgcccttccgngtaccgaagtactaaagtaaggtaaaacttaccgtttagtttcggtacgtttaccgggtaccttaacgaacgaaaaccggccggaaagggccttacgtcctacctaaacctaacttcccgtagtacttacgtttagttttacggttacttttaccggtcccgggtcccggttacccgggttccctaggtaccgttacgttaccgtacgtaggtaacggtagttcggtactcggaacggtacctaacgttaagtttaacttttaaacaagttaacgaaacttcgaagtcggaaggtaggtacggacgacgttagaacggtgttacgtacgttacggttatttacgttacgtcgtacgtagtacgtaacgtaaactaaaccgttaactaccgtttcctacgtacgttacgaacgtaaccgacgaccgtagtagagttagtacgacgtacgtgaggttccacacgttactgtcgttaccg

SEQ ID NO: 147971 - DNA, 657 bp, Homo sapiens
  misc_feature: GYAE6OF01B960N.47.87.H10.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (452)..(452): a, c, t, g, unknown or other
  misc_feature (452)..(452): n is a, c, g, or t
  modified_base (606)..(606): a, c, t, g, unknown or other
  misc_feature (606)..(606): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (647)..(647): a, c, t, g, unknown or other
  misc_feature (647)..(647): n is a, c, g, or t
tcagagctcacgtacacgaccggtgctcgatttagcagtactgcgttgggtttgggggtgatcaggactcctcagttcaccttctcacaatgacggctccctgctcagctccgtggggctgctaatgctcgtgggtctctggatcaggtggggatatgtgatgactcatctccactctccctcgcccncaccctaggancggccgcctcatctctgcgtaggtctacgctaggactctacttacaattaagtaatggataactaattattagaattcggtaactcgaacgaggaacnccgaggtccaagtccacacagtctaccgtgcttgttggttaacgggttcncgtaacggtcccggtcccggtaccggggttcccacgtaagtccggttagaggtacgaccgtagggtaggtactagtacggacctagttaaagtacgttttaaccntttaaacggaaaagtccgtaagggttaaggggtaggaccggtagtaggggaagtttaggtaagggtttttaccgggttaataaccgtggataactggtaacgtagttacttaaataacccggttctaacgttacggtttcggaccgagggtaanacggtanaacggngtacgaaacctaagggtacagggttacnctggctaaac

SEQ ID NO: 147972 - DNA, 917 bp, Homo sapiens
  misc_feature: GYAE6OF01BQB4R.47.87.H10.1.454.CMB.1.raw
  modified_base (195)..(195): a, c, t, g, unknown or other
  misc_feature (195)..(195): n is a, c, g, or t
tcagagctcacgtacacgaccggtgctcgatttagcagtactgcgttgggtttggggtgatcaggactcctcagttcaccttctcacaatgaggctccctgctcagctccgtgggctgctaatgctctgggtctcgtggactccgaggtggggattagttgtgatgactcagtctccagttcctccctgcccgtnagttcggtaggacgacgcccggtcctccgatccctccttgacgtacggttccacggaccagtaccgtccctcgtacgacgtaacgtaaccttaaagttaacggtaaaactttacccgtttaagtttacgggtacgttttaccgggtaccgtacggaaaaccgtaaaacgggccccggaaggggtaccgttaacggtaccccctaaccgtaaaccctttaaacccgtcccgtttaacggttacgttttaccgttttaaagggtttttaccggttttaaacccggtttttaaaccgggtttcccccggggtacccccggggttttacccccggggttacccgtttaccggttaaaccccggttacgggtttaccgtaaccggttacgggtacggtaagggttacggaaccggttaacgaccggtaaccgtaacgttaacgtttacttttaaactaaacggtttaaacgtaaacgttaacgaacgtaacggtaaggtaacgggtacgggacggttacgtacggtacgtggtacggttagtttaggttaacgttttacgtacgtacgtacgtaacggtacgaacttaaaccgttaaccgtaaaccctttacgttaccccgtttaacccgtacccgtaccgggtaaaccgaaacccggttaaccgtaccggtaacgaccgtaaacgtaacgttaacggacgtacgggttacgtccggtacggtaccg

SEQ ID NO: 147973 - DNA, 705 bp, Homo sapiens
  misc_feature: GYAE6OF01BUO50.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggattattgtgactgactcagtcctccagtcctccctgccctcatcgttggagacgccggcctccatcctcctgctaggtctacgccagacgccctctgcaagtactaagtaggaaaacttaccgttaagttttaggtacgtttacggtaacccgtagaacctaaaaacggccgaagggacctaacgtcctacccaactaaccttccgtagtaacttcttaagtttcggtacttttaacgtccgggtccgttcccgggtccctagacgtacggttcacgttcggcgtacgtgacgtcgaggacaacgtagttactttaacgtaagtttacgaaaacttcgagtacgaacggtacggtacggtaggtacgtacggtaacgtagttcgtacggttaggttaacgttttaacgtgtctacgtagtacgaactaaacggtaacctaaaactaacccgttccctttaccgtaaccgttaccgaaccggtaagaacctaacgtaacgttacgtaaactaggttaaacggaccgtaacgtcggtacggtactacggtaaccctactaggttctaccgg

SEQ ID NO: 147974 - DNA, 897 bp, Homo sapiens
  misc_feature: GYAE6OF01DJ0YM.47.87.H10.1.454.CMB.1.raw
  modified_base (688)..(688): a, c, t, g, unknown or other
  misc_feature (688)..(688): n is a, c, g, or t
tcagagctcacgtacacgaccggtgctcgatttagcagtactgcgttgggtttggggtgatcaggactcctcagttcaccttctcacaatgaggcctccctgcctcagctccgtgggctgactaatcgctcgtgggtctcgtaggactaccgtagggtgggtattagttggtagatcgtactcgtacgtcctccgtacgttccctcccgcgtcccgtcgtagttccggtagggacgaccggccccggtaccctccgtacttccgtacccgtgtaccggtaacgttccaggacccgacgaccgttccctccgacgacaacggtaacgtaacggtaaggtaaacttaccgtttaaggtttacggttactttacggtacctaacggaaaacgaaacggaccggaggtacctaaccgtaccctaacctaacctaacctttccgagttaaccgtttacgttttaaggttttcccggtttacgtttaaccgggtcccgggttaccccggtttaccgggtacccgttacgtaaacggttccggtttacccggacggtaccggtaggtacggtacgggtaaccgtccggtaccgaaaccgttagttaaacccgtttaagtttaacctaaggttaaacgaaccgttacggaaacgtaacggttacggggtaacgggttacgggaccgggtttaacgngggttaaacccgtaggtaacggttaccgggtttaaaggttttactttaacggttaccggacttaccggtaggtaacctaaactacgttaaaacctacccttaaccgttcccgttaaccgtaaccgggtaccgtaacgggaaacgtcccggaacgttacgtaacggtaacttaacgggtaccgtaaagtccggtcgttacgcgtaacccg

SEQ ID NO: 147975 - DNA, 879 bp, Homo sapiens
  misc_feature: GYAE6OF01B1C65.47.87.H10.1.454.CMB.1.raw
  modified_base (197)..(197): a, c, t, g, unknown or other
  misc_feature (197)..(197): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctcgtgggtctcgtggatccgaggtgggggattagttgtgatgactcagtctcctagtcctccctcgcccgtnagtcgtaggagtacgccggcctccactccgtccgtgacgtacggtctacggaccaaggtaccgtccttaacgttaacgtaagttaaaggttaacgtaggtaactttacctaaactttagtttaggtaacgtttacggtaccgtggaaccgaaggtaaccggaccgggtaaggggtaccctacgttaccccgtacccgaacgtaccggtccttcccgttaggtaacttttcggtttcggttttcggggttacctacgggtaccgggttccccggggtccccggtttccccggggggttacccttaacgggtaacccggttagggttacggtaacgggttacggggtacgtacgggtacggtaccgttacgggacgtacctaacgggttaaacttaccggttttaacgtacgttaaaaggtaaacgtcgggtaaggggttacggggtagggtaccggtagggtacgggttaagggtttacggtttacgggggtttttacggtttaacgttacgtcggtaacgtaccggttaagttaacccggtttaacctttaacgtaaccctttaaccgttccgttaaacgtttaccggtaacggggtacccgaaaggggtaaccctaggaggttaaccggaacttaaaccgaacgttaaacgggtacgttaggaccgtcgtaacgtaacccg

SEQ ID NO: 147976 - DNA, 786 bp, Homo sapiens
  misc_feature: GYAE6OF01CT3L7.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggactccgaggtgggtatattgtgatgactcagtcctcctactcctccctcgcccgtccaccccgtgggacgacgcccggcctccactcctcctgcgacggtctacgccgagacgtcctacttactaagttaagtaatggtacttactaacttagttagtaacttggtacctgtacaagaacgcgacgggctacgtcctaccacgtcgtcctccgtgtacgtttcgtttcgggtttcggttcgtaggtaccggtccgggtccccggttccgggtcccgtcgtacgtacggttacggtagtcgtacgaggtacgagtacgaggtacacgtagttacttaccgtacgtaaagtaaacgtcggtaacgggtagggtggtacggtacggttacgggtaacgggtttagtttaggggtttaacgggtttatttacgtacggtaccgtacgttacggtaaacttaacggtttaacccttaaaccgttaaccgtttaccgttacccggttttacggttaccgggttaacccgggaacggggtaaacctacgggtaaccggttagggtaaaccgtaacggttaaaaccgtaaacccggttaagggtccggtacgggtaaccgtacgtaccccgtaaccgttacgttacggttaccgtttccgttaaccccg

SEQ ID NO: 147977 - DNA, 781 bp, Homo sapiens
  misc_feature: GYAE6OF01EYDWF.47.87.H10.1.454.CMB.1.raw
  modified_base (193)..(193): a, c, t, g, unknown or other
  misc_feature (193)..(193): n is a, c, g, or t
  modified_base (555)..(555): a, c, t, g, unknown or other
  misc_feature (555)..(555): n is a, c, g, or t
tcagagctcacgtacacgaccggtgctcgatttagcagtactgcgttgggtttggggtgatcaggactcctcagttcaccttctcacaatgaggctccctgctcgagctccgtggggctgctaatgctcgtgggtctcgtggatcgagtgggatgttgtgatgactcagtctaccagtcctcccgtgcccgtnatcggttggagcgcccggtcctccatcctccgtgactggttacacggaccgtaaggaccgtcccctaccgtaggacctaacggtaaacttaaaggtaggaaaaacctttaccgtttaaggttttacggtaacgtttacggttaacccgtaggtaaaccgtaaaaacggcccggaaacggggtacgtacgttacccgaacccgtaaaccgtaaccttccgtaacgtactttaccgtttaagttttacgttaaccgttttaacggtcccgggtccgttaccccgggtccgtaagtaccgtaacggttctaaccggttgggacctaggtaggtcgtaccgaggactaagtaactttacgtttaanaagttaaagaaattcgaggaacgtaaggtaggttaggacgtagtacgaacgtgtacggtagttaaggtttacgtttactaaccgtagaaccttagtacggtaaataacgtaaaccttaaaaccttaccgttccctttaccgaacccggtttaccgggaacgaaggtaaccgtacggaagttcgaaacttaacggtaacggtaagaaccgtttgacggtcctaaacg

SEQ ID NO: 147978 - DNA, 609 bp, Homo sapiens
  misc_feature: GYAE6OF01CF4BN.47.87.H10.1.454.CMB.1.raw
  modified_base (142)..(142): a, c, t, g, unknown or other
  misc_feature (142)..(142): n is a, c, g, or t
  modified_base (172)..(172): a, c, t, g, unknown or other
  misc_feature (172)..(172): n is a, c, g, or t
tcagagctcacgtacacgaccggtgctcgatttagcagtactgcgttgggtttgggctcagttcaccttctcacaatgaggctccctgctcagctcctgggctgctaatgctctgggtctctggatccaggtgggatattgngatgactcagtctcagtctccctgcccgtnattcgttggagacgccggcctcatctcctgcaggtctagccagactcctctgcagtactaatagtaaactaccttagtttggatttcggtacctagaacaaaagccgagggctacgtctaccaactacctcctagtactcttaagtttcggtacttttaacggccgggtaccgttccgggtcctgacgtacggttcacgtcgcgaggtgactcgacgtcagtagttatttactataagaactgagcgaagtaggtgggaactgtaacgacgtagttggtacgttagggttattttacgtagtcgtacagttacgaactaacgtaactaaaccgttacttaccctttacgaaccggtccgaacggtaacggaccgtacgtaagtacgtattacgttaacgaccgtaagtcgagtcctacgacttacctgttcgtaccg

SEQ ID NO: 147979 - DNA, 837 bp, Homo sapiens
  misc_feature: GYAE6OF01EVZ0A.47.87.H10.1.454.CMB.1.raw
  modified_base (671)..(671): a, c, t, g, unknown or other
  misc_feature (671)..(671): n is a, c, g, or t
tcagagctcacgtacacgaccggtgctcgatttagcagtactgcgttgggtttggggtgatcaggactcctcagttcaccttctcacaatgaggctccctgctcagctcctgggctgctaatgctctgggtctctggactccgagtggggatatgtgatgactcagtctccagtcctccctgcccgtcagtcgtggagacgccgcctccatcctcctgcgagtctagccagacgcctcctagacagtaacttaagtacggtaaacttaccgttagtttggtacgtttacggtaaccccgttagaaccgtaaaacggccggacggggtacctacggtcctaacccgaacctaaccgttcccgttagtacttccgtttaagttttacggtaccgtttttaacgtcccggggtccccttacccgggggttaccccttaggtaacccgttacggtttacccgaacggtttcggggtactaaccggggttcggtaaaacgttccggaacgggtacccctaaggttaacgttttaaccgtttttaacccgttaagtttaacggtaaaaaccttcggtaacggtaaccggtaaggtacggtaacggggtacgggtacgttacggtaaccggtagttacggtcgtttagggttaactttaacgtttacgtaggtaaccncgggttaacggaacctaaacggtaacccttaaacctaacccgtttcccgttttaaaccgtacccgtttaaccgggaaccggtaaacggggtaacccaacggttaacggtacggtaaccttaacgttaaccggaaacgttacgttacgggttaacggtcctaaccgg

SEQ ID NO: 147980 - DNA, 497 bp, Homo sapiens
  misc_feature: GYAE6OF01AWJQC.47.87.H10.1.454.CMB.1.raw
  modified_base (88)..(88): a, c, t, g, unknown or other
  misc_feature (88)..(88): n is a, c, g, or t
  modified_base (194)..(194): a, c, t, g, unknown or other
  misc_feature (194)..(194): n is a, c, g, or t
  modified_base (263)..(263): a, c, t, g, unknown or other
  misc_feature (263)..(263): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (480)..(497): a, c, t, g, unknown or other
  misc_feature (480)..(497): n is a, c, g, or t
tcagagctcacgtacacgaccggtgctcgatttagcagtactgcgttgggtttggggaggccttgagtggctgggaaggacatactanaggtccgactggaaaagtgattatgcagaatctatgcagagccgcataaccatcactgcagacacatccaggaacctagttcctcccctaacaactgaactctgtnaccgtcccgaggacacggctatatattactgtagaagcgtccgtcgaccgtgggactacgggtttaccnccggtacgggccgacgggaccctggtcctccgtctccncnccnccnccaccgacggcccagtccgtccctccccgcgccgcctcgccncgacgaccnccgacccgtacgagcgccacgcggccggccgtggctcggccgtcgacgtaacgtaccttaccgttcgacgtcgtacgtcctcggacggngggtccggagtcggacgacgggcanagtgcnnnnnnnnnnnnnnnnnn

SEQ ID NO: 147981 - DNA, 878 bp, Homo sapiens
  misc_feature: GYAE6OF01ART0S.47.87.H10.1.454.CMB.1.raw
tcagagctcacgtacacgaccggtgctcgatttagcagtactgcgttgggtttgggctcagttcaccttctcacaatgaggctccctgctcagcctcctggggctgctaatgctctgggtctctggatccaggtgggatattgtgatgactcagtctccagtcctccctgcccgtcatcgtgagagccgcctccatctccgtgcgaggtcctagccagaccgcccttccgtagcaagtactaagtaggtaaacttacccttagtttacggtatttacggtaccctaggaaccgtaaaaacggccgaacggggtacctaacggttaccctaaccccgtaaacctaacccttaccgttacgtaacgttttacctttaaggttttaccgggtttaacccgtttttttaaacggcccccgggggtttccccggtttaacccccgggggttaccccgtaggtaaaccggttacgggtttaacccgtaacggttccgggtaaccgtacgggttcgggaaccgttaccggaacggaaccttaacgtaaacggtttaacttttaaaccgtaagtttaaccgtaaaaacgtcggtaaccgtacggtaaagggtaacggttacggggaacgtaccgttacggaacggttaactccgaggttttacggtaacgttttacgttccgtagctaacgttgaaccgttaaaggtaaacccttaaaacccgtttaaccccgtttccgttttaaacccccggtaaaccggtttacccggaaaccgggttaaaccgacctaaccgggtaaccgttaggaaaccgttacggtaaacgtacccgtaaagtccggttacgtaccgtacgtacccgtaaaccctgtacccggtttaaccg

SEQ ID NO: 147982 - DNA, 794 bp, Homo sapiens
  misc_feature: GYAE6OF01EWY4E.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctcgtggatccaggtggggatattgtgatgactcagtctccagtcctcccgtcgcccgtctagttcggttggagacgccggcctcatcctcctgcgtaggtctacgccagacgtccctcgtagcaacgtaacttaagtaacggtaaaacttaccttagttaggtagtttacggtaacctaggtaacgaaaacggccggtaaggggtcctacggtaccctacctaaacctaccgttcctagttaacttcgttttaacgttttacggttaccgttttaacgggtcccggggttccggttaccccggggtacctacggtacgttaccggttacacggtcgggtacgtaggttacggaactccggaacgggtacctaacgttaagtttaacgtttaaacttaagttaaacgtaaaactaccgaaggtaacgaagggtagggtagggacggtaccgtagggaacgttaggtcggttacgttagggttaattttacgtacgtagtaccgtagtacctaacgtaaacgttaacctaaaccgttacccttttaccgttacccggttaaaccgaccgggtaaaccggaacggtaacccgtacggtaaacccggtaggttaaacctaaacggttaaccggtaaccggttaagtccgggtcgtaacgtaccgg

SEQ ID NO: 147983 - DNA, 985 bp, Homo sapiens
  misc_feature: GYAE6OF01B1ZNX.47.87.H10.1.454.CMB.1.raw
tcagagctcacgtacacgaccggtgctcgatttagcagtactgcggttgggtttggggtgatcaggactcctcagttcaccttctcacaatgaggctccctgctcagctccgtgggctgctaatgctctgggtctcgtggactccgaggtgggtattattggtagatcgactacgtacgtctcctacgtcctcccgtcgcccgtcgtcgttcggttacgggacggaccggcccggtcctacctacttcccgtccgtacggtaccggtaacgggttacctaacggacccgaacggtccgtccccttaccgtcgaaccgtaaacgttaaccgttaaaggtaacggttaaaacctttaaccggtttaagtttaggttaacgtttaccgggtaacccgttacggaaacccgtaaaacggccggtaacgggtacccgttacgtacccctaacccgtaacccgtaaccgttaccgtagttactttaacgtttaacgttttacggtttaccgttttaaccggtccccgggtacccggggtttcccgggtaccgtaacggtaccggtaccggtttacgaccggttacggacggttaaggtacggtacgaccggggtaacgaaccgtaacggtttaacttttaaacgttaaccgttaaagtttaaacgtaaacgtaccggtaaacggtaacggtaagggtaacgggttacgggtaacgggttacggtaacggtacgtacgggtttacgttacgggtttaacgggtttaacgttttaacgtttacgggtaaccgttacgaacgttaaccggtaaccgtaaaacggttaaacccttaaacccctaaccgttttaacccgttaaccggttaccccggttaaacggaaccccgggtaaaccggtaacggttaacccgggtacggttaaaccggttaacgttaaaccgttaaaacgggtccggtttaaaaccggtcgggttaaccggtcggttaaaccc

SEQ ID NO: 147984 - DNA, 832 bp, Homo sapiens
  misc_feature: GYAE6OF01D299A.47.87.H10.1.454.CMB.1.raw
  modified_base (191)..(191): a, c, t, g, unknown or other
  misc_feature (191)..(191): n is a, c, g, or t
  modified_base (600)..(600): a, c, t, g, unknown or other
  misc_feature (600)..(600): n is a, c, g, or t
tcagagctcacgtacacgaccggtgctcgatttagcagtactgcgttgggtttggggtgatcaggactcctcagttcaccttctcacaatgaggctccctgctcagctccgtggggctgctaatgctcgtggtctctggatccaggtgggatagttgtgatgactcagtctccagtcctccctcgcccgtntagtcgtggacgcgccgcctccactcctcgtcgctaggtactcgaccgacgacgtccctctgactaacgtactaaagtacggtaaaacttaccttagtttcggtagttaccggtacctacggaacgtaaacggccggtagggcctacgtacctacccaaacctaaccttcgtacgtacttacgtttagttttacggttaaccgtttttaaccggtcccggggttcccccggttaccccggggttaccgttacggtaaccggttaccgggtttaccgtaaccggttcgggtaccgtagggtaccggtacgtaaccggacgtacgtaaacgttaggtttacgtttacgaactttaacgtaaacgttaaactacgggaacgtacgtaaggggtaccgggtaggtaccgggtntaacggggtacgtacgttacgggttacggttaagggtttaaccgtttttacggtaacgtgtaacggtaataccggtaaacttaaaccgttaaaccggtttaaacccttaaaccctttcccgttaacccgtaccggttaacccgggaaccggttaaaccgggtacgtaacccgttaaccgggtaagttaacctaaacggtaaccgggtaaacgttacgggtggtaaccgtcgg

SEQ ID NO: 147985 - DNA, 530 bp, Homo sapiens
  misc_feature: GYAE6OF02FT58T.47.87.H10.1.454.CMB.1.raw
  modified_base (526)..(526): a, c, t, g, unknown or other
  misc_feature (526)..(526): n is a, c, g, or t
tcagagctcacgtacacgaccggtgctcgatttagcagtactgcgttgggtttggggtgatcaggactccctcagttcaccttctcacaatgaggctccctgctcagctcctggggctgctaatgctctgggtctctgggatccaggtggggatattgtgatgactcagtctccagtcctccctgcccgtcatcgttggagagccggcctccatcctcctgcaggtctagccagacgcctcctgcagactaatggaaatacctatttggattggtacctgacaaaagccagggcagtctccacaactcctgatctatttggtcttttaatcgggcctccgggtccctgactaggttcacgtggcagtgatcaggcacagtattttacattagaaaatcagcagagtggagatgacgatgcgtggtagtttattacgtgcatgacaagactaaaacaaaccttcctttaccaccgttccggaccgaagggaccacgtacgtagactattacgaacgaactgtacggntacg

SEQ ID NO: 147986 - DNA, 501 bp, Homo sapiens
  misc_feature: GYAE6OF02H01TZ.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctctgcagactaatggaaatacctatttggattggtacctgacaaaagccagggcagtctccacaactcctgatctatttggcttttaatcgggcctccgggtccctgacaggttcactggcagtggatcaggcacagtattttacatttagaaaatcagcagagtggaggctgacgatgctggagtttatactgcatgacaagctaaacaactcctttacaccttcggaccaaggacacgactagacagttagacgaactgtggctcg

SEQ ID NO: 147987 - DNA, 512 bp, Homo sapiens
  misc_feature: GYAE6OF02HJW9B.47.87.H10.1.454.CMB.1.raw
  modified_base (323)..(323): a, c, t, g, unknown or other
  misc_feature (323)..(323): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctatttggcttttaancgggcctccgggtccctgacaggttcactggcagtggatcaggcacagtattttacatttagaaaatcagcagagtggagctgacgatgctggatttatactgcatgacaagactaaaacaaccttccttaccaccttcggaccgaagggcacggactggaacagttacgacgtaactggtacgctacg

SEQ ID NO: 147988 - DNA, 512 bp, Homo sapiens
  misc_feature: GYAE6OF02F6O93.47.87.H10.1.454.CMB.1.raw
tcagagctcacgtacacgaccggtgctcgatttagcagtactgcgttgggtttggggactgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccggggtcctgacaggttcactggcagtggatcgaggcacagtattttacattgaaaatcagcagagtggaggctgacgatgctggtagtttattacgtgcagtgacaagactaaaacaacttcctttacaccgttcggaccaagggacacgacgtaggactagttagacgtaactgtgcg

SEQ ID NO: 147989 - DNA, 494 bp, Homo sapiens
  misc_feature: GYAE6OF02I09V1.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctattggattggtacctgcaaaagccagggcagtctccacagctcctgatctgtttggtctgatcggcctccggggtcctgacaggttcagtggcagtggatcagcacagattttacgctagaaatcagtagggtggagctgaggatggttgggtttatactgcatgctaagttctacaacttctactactttggccagggaccaagctaggagatacgaacgacgtgtggctgctacc

SEQ ID NO: 147990 - DNA, 530 bp, Homo sapiens
  misc_feature: GYAE6OF02HY2J2.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccgggtccctgacaggttcacgtggcagtgatcgaggcacagtattttacatttagaaatcagcagagtggaggctagacgatgctggtagtttattactgcatgacaagactaaacaaccttcctttactaccgttacggaccgaagggaccacgacgtacggaactacgttagaccgtaacgtggtacggctacgacctacctactcgttcg

SEQ ID NO: 147991 - DNA, 508 bp, Homo sapiens
  misc_feature: GYAE6OF02JBRSS.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccgggtccctgacaggttcactggcagtggatcaggcacagattttacattgaaaatcagcagagtggaggctgacgatgctggagtttatactgcatgacaagactaaacaacttcctttacaccttcggaccgtaagggaccacgtactggaacagttacgacgaactgtggctacg

SEQ ID NO: 147992 - DNA, 503 bp, Homo sapiens
  misc_feature: GYAE6OF02GA2JI.47.87.H10.1.454.CMB.1.raw
  modified_base (500)..(500): a, c, t, g, unknown or other
  misc_feature (500)..(500): n is a, c, g, or t
tcagagctcacgtacacgaccggtgctcgatttagcagtactgcgttgggtttggggtgatcaggactcctcagttcaccttctcacaatgaggctccctgctcagctcctgggctgctaatgctctgggtctctggatccagtgggatattgtgatgactcagtctccagtctccctgcccgtcatcgttggagagccggcctccatctcctgcaggtctagccagagcctcctgcagactaatggaaatacctattggattggtacctgcaaaagccagggcagtctccacaactcctgatctatttggcttttaatcgggcctccgggtccctgactaggttcacgtggcagtggatcgaggcacagtattttacattagaaaatcaagcagagtggaggctgacgatgctaggtagtttattactagcatgacaagactaaacaactcttacacctcgaccaaggaccacgactggacagttacgacgtatggtgntcg

SEQ ID NO: 147993 - DNA, 514 bp, Homo sapiens
  misc_feature: GYAE6OF02IKLFE.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagcccagagcctcctgcagactaatggaaatacctattggattggtacctgcaaaagccagggcagtctccacaactcctgatctatttggcttttaatcgggcctcgggtccctgacaggttcactggcagtgatcaggcacagtattttacattgaaaatcagcagagtggaggctgacgatgcgtggagttttattacgtgcagttgacaagtactaaacaaacttcctttaccaccttcggacccaagggaaccacgactggaacattacgacgaactggtggctcg

SEQ ID NO: 147994 - DNA, 561 bp, Homo sapiens
  misc_feature: GYAE6OF02G2VWO.47.87.H10.1.454.CMB.1.raw
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctattggattggtacctgacaaaagccagggcagtctccacaactctnatctattgtactttagcggtccgtccggtccngactagtcacgtgcagtgatcgaggcanagtatttacattagaaatnagcgagagtggagacgtgacgatcgagttggtagtttagttactgacgtagtcgaacgtaacgtaactaaaacgtaaccttccctttacctaccgtttccgggaacccgtaaacgggacctaaccggtacgtaacggtaacctagttaacggaaccgttaacgtcggttagaccgtacg

SEQ ID NO: 147995 - DNA, 505 bp, Homo sapiens
  misc_feature: GYAE6OF02F7UYX.47.87.H10.1.454.CMB.1.raw
  modified_base (411)..(411): a, c, t, g, unknown or other
  misc_feature (411)..(411): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgcaaaagccagggcagtctccacaactcctgatctatttggcttttaatcgggcctccggggtccctgacaggttcactggcagtggatcaggcacagtattttacatttagaaatcagcagagtggagctgacgatgctggatttatacngcatgcaagactaaacaacttcctttacaaccttcggacaagggacacgactacggaacaattacgaacgtaacgtgtggctgacaccatctcg

SEQ ID NO: 147996 - DNA, 650 bp, Homo sapiens
  misc_feature: GYAE6OF02ICJCK.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctattggtacttttagtcggtccgtccgggtccctgacgtaggttcacgtggcgtagtggactcgaggcaacgtagttaacttttaacgaagtttagaaaacttcgaggtacgtaggtaacggtgggtacgggtacttggaaccggtagttcggtaccgtttagggttaagttttacttaaccgtgtaccgtaagttaggacgtaaacggtaaccttaaaaaccgaaaccgtttccctttacctacccggtttacggaaccgtaaacggggacctacggtaacgttacggaaacttacggttaacggaaccgttaaacgtggttacggacttaccggacctacctagtccttacgg

SEQ ID NO: 147997 - DNA, 430 bp, Homo sapiens
  misc_feature: GYAE6OF02IVTSE.47.87.H10.1.454.CMB.1.raw
  modified_base (253)..(253): a, c, t, g, unknown or other
  misc_feature (253)..(253): n is a, c, g, or t
  modified_base (422)..(430): a, c, t, g, unknown or other
  misc_feature (422)..(430): n is a, c, g, or t
tcagagctcacgtacacgaccggtgctcgatttagcagtactgcgttgggtttgggaggccttgagtggctgggaaggacatactacaggtccgactggaaaagtgattatgcagaatctatgcagagccgcataaccatcactgcagacacatccaggaaccagttctccctacaactgaactctgtgactcccgaggacacggctatatattactgtgtaagagtccgtcacctgggacagggttttaccnccgtggggccagggaaccctggtctccgtctcctcagcctccacaaggcccatcggtcttcccctggcgccctgctccaggagcacctccgagagcacagcggccctgggctgcctggtcaaggctacttcctacgtgagctctgagcgggctggcaagggcgcatagnnnnnnnnn

SEQ ID NO: 147998 - DNA, 549 bp, Homo sapiens
  misc_feature: GYAE6OF02H9XVC.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctcccacaactcctgatctatttggcttttaatcgggcctccgggtcctgacaggtcacgtgcagtggatcaggcacagtattttacatttagaaatcagtcagagtggaggctagacgatgcgttggtagttttattactgcatgacaagactaaacctaacttccctttacaacccgttacggaccgaagggaccaccggactacgggaactaagttaacgaaccgtaaacgttggtacggactcggaccgtaacctacgttcttaccg

SEQ ID NO: 147999 - DNA, 521 bp, Homo sapiens
  misc_feature: GYAE6OF02IXKSL.47.87.H10.1.454.CMB.1.raw
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (517)..(517): a, c, t, g, unknown or other
  misc_feature (517)..(517): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtgggggatattgtgatgactcagtctccagtctccctgcccgtcatcgttggagagccggcctccatctcctgcaggtctagccagacgcctcctgcagactaanggaaatacctattgattggtacctgacaaaagcagggcagtctccanaactcctgatctatttggctttaancgggcctccgggtcctgtacaggttcacgtcggctagtgatcaggcaagagtatttacattagaaatcagcagagtggagctagacgatgcttggtagtttatacgtgacattgacaaagtactaaacgtaaacctccttacaccgttacgaccgaagggacctagaactggaactagtacgaccaagtcgtacgntacg

SEQ ID NO: 148000 - DNA, 514 bp, Homo sapiens
  misc_feature: GYAE6OF02I3LYJ.47.87.H10.1.454.CMB.1.raw
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcacccctggagagccggcctccatctcctgcaggtctagccagagcctcttacatagtaatggattcaactatttgaattggtacctgcagaagccagggcagtctccacagctcctgatctgtttggtctgatcggcctcgggtccngcaggttcagtgcngtgatcaggcacagtatttacgctagaaatcgaggtagggtggaggcgtgaggtagttggtttggggtttattacgtgcgtatgataagttctaactaaacttcctactactttggccgtagggaccaaggtctaggagtatacgaacgactgtggctgctaaccg

SEQ ID NO: 148001 - DNA, 537 bp, Homo sapiens
  misc_feature: GYAE6OF02GWPVV.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctatttggcttttaatcgggcctccgggtccctgacaggttcactggcagtggatcgaggcacgtagtattttacattagaaaatcagcagagtggaggctggacgatgcgtggtagtttattactgactagtgacaagtacctaaaaccaaacttccctttaccaccgttccggaccgaagggaccacgacgtaggacctaagttacggaccgtaagtgtaggctacgg

SEQ ID NO: 148002 - DNA, 598 bp, Homo sapiens
  misc_feature: GYAE6OF02H0NEY.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccaggtggggatattgtgatgactcagtctccagtcctccctgcccgtcatcgttggagagccggcctccatcctcctgcaggtctagccagacgccctcctgcaagactaaataggaaattacctagtttggattggtacctgacaaaagccagggcagtctaccacaactcctgatacttatttggtactttaagtccggtccgtccgggtccctgtactaggttcacgtggcagtgactcgaggcactagtatttacattacgaaatcaagcaagaggtggaggtctaggacgatggacgtaggtagttttattacgtagctaagtacgaacaacgtaacttaaaactaaaccgtttaccctttaccgaccgttaccggtaaccgaaaaggggtacccaacggtaaccgtaaggtaacctaagttaacgaaccggtaacgtggtacggactacgg

SEQ ID NO: 148003 - DNA, 625 bp, Homo sapiens
  misc_feature: GYAE6OF02IPAHF.47.87.H10.1.454.CMB.1.raw
  modified_base (362)..(362): a, c, t, g, unknown or other
  misc_feature (362)..(362): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctctgcagactaatgaaatacctatttggattggtacctgacaaagccagggcagtctccacaactcctgactctatttggtacttttaagtcgggtcctccggggtccctgactaggttcacgtggcagtggatcaggcaanagtattttacattagaaatcagacagagtggagctagacgtatgtacgttaggtagttttaactttacgagtcagttaggacctaaagtaacctaaaacctaaaccgtttacccttttaccgtaaccccggtttaccggaaacccggtaagggaacccgtaccggtaacggttacgggtaaccgttaacgttaacggaacccgttaaacgttggttacggaccgtttaccggaaccctaacccgtacgttattaacccggggg

SEQ ID NO: 148004 - DNA, 551 bp, Homo sapiens
  misc_feature: GYAE6OF02JG2B1.47.87.H10.1.454.CMB.1.raw
  modified_base (346)..(346): a, c, t, g, unknown or other
  misc_feature (346)..(346): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctcccctgcccgtcatcgttggagagccggcctccatctcctgcaggtctagccagacgcctcctgcagactaatggaaatacctatttggattggtacctgacaaaagccagggcagtctccacaactcctgatctatttggcttttaatcgggcctccgggtccctgacaggttcacgtggcngtggatcgaggcacgagtattttacattagaaatcagcagagtaggaggctgacgatgtacgtgtagtttattacngacngtagacaagtactaaacaaaccttctttacctaccgtcggaccgtaagggaccacgtacgtggaacctaattacggaaccgtaacgttgtacgggtacctacggacctaaccgtagttccgtacg

SEQ ID NO: 148005 - DNA, 535 bp, Homo sapiens
  misc_feature: GYAE6OF02IMKBN.47.87.H10.1.454.CMB.1.raw
  modified_base (492)..(492): a, c, t, g, unknown or other
  misc_feature (492)..(492): n is a, c, g, or t
  modified_base (499)..(503): a, c, t, g, unknown or other
  misc_feature (499)..(503): n is a, c, g, or t
  modified_base (505)..(505): a, c, t, g, unknown or other
  misc_feature (505)..(505): n is a, c, g, or t
  modified_base (507)..(509): a, c, t, g, unknown or other
  misc_feature (507)..(509): n is a, c, g, or t
  modified_base (511)..(535): a, c, t, g, unknown or other
  misc_feature (511)..(535): n is a, c, g, or t
tcagagctcacgtacacgaccggtgctcgatttagcagtactgcgttgggtttgggaggccttgagtggctgggaaggacatactacaggtccgactggaaaagtgattatgcagaatctatgcagagccgcataaccatcactgcagacacatccaggaaccagttctccctacaactgaactctgtgactcccgaggacacggctatatattactgtgtaagagtccgtcaccgtgggactagggttttacctccgtggggccagggaaccctggtctccgtctcctcagcctccaccaacgggcccagttccggtccttccccccgtggccgccctcgcctccaggacgccacctcccgagacgcacacggccggccccgtggggcctgcccgttggcgaaacggtaccttacctttcccgtacgtcggacgtccttcgtggacggtcggggcgttgggaccgaaacggggtccgaccgaagttacggntcgacgnnnnngngnnngnnnnnnnnnnnnnnnnnnnnnnnnn

SEQ ID NO: 148006 - DNA, 584 bp, Homo sapiens
  misc_feature: GYAE6OF02FLLYD.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacccgcaaaagccagggcagtctccacactcctgatctattggtcttttaagtcgggcctccggggtccctggacaggttcacgtggcagtggatcaggcacagtattttacattagaaatcagcagagtggagctgacgatgctggtatttattactgactatcggctaaagacttaaaacctaacttcctttaccgtaaccgtttaccggacccgtaaacggggaccaccggtaccttacgggaaccttaacgttaacggaaccggtaaaccgtttgggtacgggtccttacggacccttaacccgtacttcgttacggtttaccc

SEQ ID NO: 148007 - DNA, 642 bp, Homo sapiens
  misc_feature: GYAE6OF02HNJ2S.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagccagagcctcttacatagtaatggattcaacttattgaattggtacctgacagaacgccagggcagtctccacagctcctgatcttgtttggttctgacgtccgggtccgtccggggtccctggacgtaggttcaggtgcgaggtgatcgaggcacagtatttacgctagaaatcgaaggttagggtagggaggcgtaggtagggtagtttagggttttagggggtttaatttacgtggtacctagttacggtaccgttaaaggttaccctttaaaccgtaaacccttttcccgtaaacgtttaccgttttaccgggacccggaacggggttaacccaaaggtcggtacgggtaaagtaaccgtaacgtaaaaccggtacggttacggtacgggtaccgttacggaccctaaccg

SEQ ID NO: 148008 - DNA, 592 bp, Homo sapiens
  misc_feature: GYAE6OF02ITQJ0.47.87.H10.1.454.CMB.1.raw
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (485)..(485): a, c, t, g, unknown or other
  misc_feature (485)..(485): n is a, c, g, or t
tcagagctcacgtacacgaccggtgctcgatttagcagtactgcgttgggtttgggggcagcgcctgctgaattctggctgaccagggcagtcaccagagctccagacaatgtctgtctccttcctcatcttcctgcccgtgctgggcctcccatggggtgtcctgtcacaggtacagctgcagcagtcaggtccaggactggtgaagccctcgcacgaccctctcacctccacctgtgccatcgtacgggacagtagtctctagcaactagtggttggttggaattggatcgaggcacggtccccgttacgggacgtccgttggaggtgggacgtaggggaacggactaagtacgtacgtacgggtaccgacgtaggaaagtgattangacagatctagngacaggacgccgataacgtaacctagtaccaacgtgacctaaggaaccacacgtacgaacggaaccttacgtccctaaccctanaaactccgtacctcgtagtacgaccctacggacgactacggtataacttaactacttatacggtagttaaggctaccgttacggacgttacgggacctttaaccggg

SEQ ID NO: 148009 - DNA, 661 bp, Homo sapiens
  misc_feature: GYAE6OF02G99CI.47.87.H10.1.454.CMB.1.raw
  modified_base (314)..(314): a, c, t, g, unknown or other
  misc_feature (314)..(314): n is a, c, g, or t
  modified_base (384)..(384): a, c, t, g, unknown or other
  misc_feature (384)..(384): n is a, c, g, or t
tcagagctcacgtacacgaccggtgctcgatttagcagtactgcgttgggtttggggactgatcaggactcctcagttcaccttctcacaatgaggctccctgctcagctcctggggctgctaatgctctgggtctctggatccagtggggatattgtgatgactcagtctccactcctccctgcccgtcaccccgtggagcgccggcctcatctcctgcaggtctagccagacgcctctacatagtaatggattacaacttatttagaagttggtacctgactaagaacgccgagggcaacgtcctaccaacncgcctcctgacttccgtttggtttcgggttctgtacgttccggggtcccgtccggggtcctggtaaccgngggtttccagggtcggctaggtcggacttcggaggctacgtaacgttaagttttcgtacgtagaaaagttcgagggttaggggtaggaggtcgtaggagggtagtttgggtttagggtttagttacgtggtactagtcgtacgtaacgttacttaaacctaaacctttacctaacgttacgttttcggaccggtaacggggtacctaacggtcgtaagggtaacgttaagtaacccgtaaaacggtacgttacggtaacggtccgttaggtaacccc

SEQ ID NO: 148010 - DNA, 659 bp, Homo sapiens
  misc_feature: GYAE6OF02ISZOE.47.87.H10.1.454.CMB.1.raw
tcagagctcacgtacacgaccggtgctcgatttagcagtactgcggttgggtttggggtgatcaggactcctcagttcaccttctcacaatgaggctccctgctcagctccgtggggctgctaatgctctgggtctctggatccagtggggatattgtgatgactcagtctccacgtctccctgcccgtcatcgttggagagccggcctccactcctcctgccaggtctagcccagagtccctacctgtccagtactaatggaaacttacctatttaggattggtaacctgacaaaagcccagggcagtctccacaactcctgtatctagtttggtacgttttaactcggtcccgtccggggttccctaggaccgtacggttcctacgtggacctaggtcgagttcgaggaccacgtagtactttaactacttagaaaatcgagcaaggaggtaggagacgttagtacggattggtacgttaggtagttttaatacgtagtactaattggaacctaaggtaacccttaaaacgttaaaccgtccgtttaaccgtacccgtttaccgggaacccgtaaacgggaccgtaaccggtaaccgttacgggtaacccgtaacgttacggtaaccgaaccggtttacggttaccgggcttaccgg

SEQ ID NO: 148011 - DNA, 659 bp, Homo sapiens
  misc_feature: GYAE6OF02J1R20.47.87.H10.1.454.CMB.1.raw
  modified_base (173)..(173): a, c, t, g, unknown or other
  misc_feature (173)..(173): n is a, c, g, or t
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtgggatattgtgatgactcagtctccagtctccctgcccgtnatcgtggagngccgcctccatcgtcctgctaggtctagccagngccctctgcagactaagtggaaatacctattgatggtactgctaaaagccagggnaagtctaccacaactcctgacttctaatttcggcttttaacgcgggtccgttccggggtcccctggaacgtacgggttccacgtcggcgtaaggtcggattaccgaggactaaccagttaattttaacgagtttacgaaaagttccaagtaccgaagtaggtaggtaggtaccagggtactagtacgtcgttaggttaagtttagtttaactggctagtacgtagaacgtaactaaaaccttaaaaccgtccttttaacccgtaccttaccgggtaacccaacgggtaaccaccggtaacgttacgggtaaccttaaggttaacgtaaacccggtaacttcggtacgggttacctcggtaaccgtaaccccgtacttaaccgttccgg

SEQ ID NO: 148012 - DNA, 581 bp, Homo sapiens
  misc_feature: GYAE6OF02GH4JW.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctattggattggtacctgacaaaagccagggcagtctccacaactcctgatctattgtctttaatcgggcctccgggtcctgacgtggttcacgtggcagtggatcgaggcacagtaattttacatttagaaatcagcgagaggtgggaggtcgtaggacgagtcggcgttaggtagtttttaataccgtgacctagtcgacgtaaagtacctaaaacctaaaccttaccctttacctacccggtttaccggaccggtaaacgggtaccaaccggtaccgttaggaacctagttaacggaaccgtaccgttaggtacggctaaccg

SEQ ID NO: 148013 - DNA, 526 bp, Homo sapiens
  misc_feature: GYAE6OF02F3C9E.47.87.H10.1.454.CMB.1.raw
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagacgcctcctgccagactaatggaaatacctatttggattggtacctgcaaaagccagggcagtctccacaactcctgatctattgtctttaatcggcctccgggtcctgacacggttcagtggcagtgatcgaggcacngtatttacattagaaatcagcagagtggagctgacgatgcgtggtagtttattacgtganatcgactaacgactaaacaaccttccttacacccgttcggaccgaaggtaccacgtacgtacggactaacttacggacgtaacgtcgtacggctacgg

SEQ ID NO: 148014 - DNA, 617 bp, Homo sapiens
  misc_feature: GYAE6OF02GLZIS.47.87.H10.1.454.CMB.1.raw
  modified_base (187)..(187): a, c, t, g, unknown or other
  misc_feature (187)..(187): n is a, c, g, or t
  modified_base (433)..(433): a, c, t, g, unknown or other
  misc_feature (433)..(433): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtnatcgttggagagccggcctcatctcctgcaggtctagccagagccctcctgcagactaagtaggaaatacctatttggattggtacctgacaaaagccgagggcagtctccacaactcctgatcttatttggtactttaacgtccgggtcccgttcccggggtccctggactacggttcacgtcggctaggtcggatcaggcaacgtagtatttaacattagaaaactcaagcaaggagtggaggntacggacgtagtgcgttaggtaagttttattacgtaggactagtcgaacgtaaacgtaaccttaaaaacgtaaccctttaccctttaccgtacccgtttaccgggaacccgtaaaggggaaccctacggacgttaacgggactaacgttacggtaaccgtaaccggtggttaccggctaaccgg

SEQ ID NO: 148015 - DNA, 855 bp, Homo sapiens
  misc_feature: GYAE6OF02GOH4R.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagacgccggcctccatctcctgcaggtctagccagagcctcctgcagactaagtggaaatacctattggattggtacctgacaaagccgagggcagtctaccacaactcctagactcttagtttggtactttttaagtccgggtccgttcccgggggtcccttaggaccgtacgggttccacgtcgggactaggttcgggactacggacggtaccaacgtaacgttaactttttaacgaagtttaaacggtaaaacttccgaacggtaccgtaagggtaagggttacggggtaaacgggtccgttaaagggtaaccggtaacgttacggttaccgggtttaggggtttaaacggtttttaactttaaccggttacgtacgttaacggttaaccgtaaaccggtaaaaccggttaaacccgtttaaaaacccgttaaaccccgtttttaccccgtttttaacccgttaaaccccggttttacccggggtaaaaccccggtaaacgggggttaacccgttaacccggggtaaacggtttaaccggggtaaaccgttaaaccgggtttaaaccggggtaaacccggttaaacccggttttaggggttaaccggggttacccgttaaacccgggtaaccccgtaacccgtttaccggttacccgtttttaacccggg

SEQ ID NO: 148016 - DNA, 642 bp, Homo sapiens
  misc_feature: GYAE6OF02IC5HO.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctctggatccagtgggatatgtgatgactcagtctccactctccctgccgtcacccctggagacgccggcctccatctcctgcaggtctagccagacgcctcttacatagtaatggattcaacttattgaattggtacctgacagaagccgagggcagtctaccacagcctcctgattcgtttggtttgggttctggtacgtccgggtcccgttccgggggtcccctaggaccgtacgggtttcacgggttcgggactagggttcggacttcgacgggtcctaacgtagtaacgttttacggacctaagtaaaactacgtaagggttaggggtgggtaggacgttaggtaggtagttgggttagggtttatacgtgtcgtagtgtacgtaagttacgtaacttaaaccgttaccttaacgttacgtttacggaccgtaacgggtaccgtaaggtacgtaggtaacgtaactaacggtaaacgtacgtacggtcggtacgtcgacctaaccg

SEQ ID NO: 148017 - DNA, 542 bp, Homo sapiens
  misc_feature: GYAE6OF02FJRD2.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgccccgtcatcgttggagagcccggcctccatctcctgcaggtctagccagacgcctcctgcagactaatggaaatacctatttggattggtacctgacaaaagccagggcagtctccacaactcctgatctatttggcttttaagtccgggcctcccggggtccctgactaggttcactggcagtggatcgaggcacagtattttacatttagaaatcagcaggagtggaggctagacgatgacgttggagttttatactgactagtgacaagtactaaaactaacttccctttacaccgttcggaccgaaggacaccgactaggtactaagttaacgacgtaacttggtcgcttcgacctaccattccttacg

SEQ ID NO: 148018 - DNA, 638 bp, Homo sapiens
  misc_feature: GYAE6OF02IRGS3.47.87.H10.1.454.CMB.1.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
tcagagctcacgtacacgaccggtgctcgatttagcagtactgcgttgggtttgggctcagttcaccttctcacaatgaggctccctgctcagctcctgggctgctaatgctctggtctctggatccagtgggatattgtgatgactcagtctccagtcctccctgcccgtcatcgttggagacgcccggcctccatcctcctgcaggtctacgccagacgccctccgtgccaagtactaaagtaggaaacttacctagtttggattcggtacctgacagaacgccgagggcagtctccanacgcctctgattcgttggtttggtctgacgtcggccgttccgggtccngacgtgtcgagtcgctagtggatcgagctaacgagtttacgtttacgacgtaagtaaacgtcggaagggtagggtaggaggtcgtaggtaaggtagtttagggtttagggtttaactacgttgtactagtacgtaacgttaacgtttacttaaccgtaaacgtttacccgttaacgttacgtttacgggaccgtaaccggggtactacgggtacgtaggtaacgtaacgtaacgtaaacgtaacgttaggtacgtacgccgtaccgtacctacgttaccgttcttaccg

SEQ ID NO: 148019 - DNA, 547 bp, Homo sapiens
  misc_feature: GYAE6OF02FHUEZ.47.87.H10.1.454.CMB.1.raw
  modified_base (418)..(418): a, c, t, g, unknown or other
  misc_feature (418)..(418): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggctccatctcctgcaggtctagccagagcctcctgcagactaatggaaatacctatttggattggtacctgacaaaagccagggcagtcctaccacaactcctagatctatttggtacttttaagtcgggtccttcccggggtccctgactaggttcacgtggcagttggatcgaggacacgagtattttacgctagaaactcgaaggtagggtggaggtctggaggtntggcgtggttagtttatactgctagtgacaagactaaactaactcctttacaccgttcgaccgaaggacctacgactacgaacagttaacgacgtaacgtgtagctagaccacctatctagtcttaccg

SEQ ID NO: 148020 - DNA, 606 bp, Homo sapiens
  misc_feature: GYAE6OF02G9PD5.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagacgccggcctcatctcctgcaggtctagccagacgcctcctgcagactaatggaaactacctattggattggtacctgacaaaacgccgagggcagtcctaccacaactcctgactcttagttcggtacttttaagtccgggtccgttccgggtccctagactaggttcacgtggactaggtgatcgacggacacagttactttacattaagaaaactcgaagcaaggtacggtagggaggtcgtaggaacgtagtcggacgttaggttaacgttttatacgtagacctagtacgactaaacgtaacctaaaacctaacctttcccttacgtacccgtttacggaacccgaacgggacctaacgtacgtaggtaactacggttaacgacgtacgtggtacgtcgtacg

SEQ ID NO: 148021 - DNA, 651 bp, Homo sapiens
  misc_feature: GYAE6OF02FFJRC.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtgggatattgtgatgactcagtctccactctccctgcccgtcacccctggagacgccggcctccatctcctgcaggtctagtcagagcctcttacattagtaatggattcaactatttgaattggtacctgcagacgccagggcagtcctccacagtctcctgattcgttggttttcgggtctggtacgtccgggccgttccgggggtcctggactggttcaggtggactaggtggactcgaggcacgtagtacttttacgacgtaacgaaagtcgtaagggttaggggtagggaggtcgtaggaagggttacggtttagggtttaggggttttaacttacgtagtcgagttacgtaccgttaacgtttaccttaaaccgttaaacctttacccttaacgttaccgttttacggaccggtaacggggtaaccaacggtcgtaacgggtaacgtaacgtaaccgtaaacggtaacggtacggtacggtacgtaccgtaccgtaacccg

SEQ ID NO: 148022 - DNA, 554 bp, Homo sapiens
  misc_feature: GYAE6OF02HK8CN.47.87.H10.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtcctccctgcccgtnatcgttggagacgcccggcctccatctcctgcaggtctagccagagcctctgcagactaanggaaatacctattggattggtacctgacaaagccaggcagtcctccacaactcngatctattgtacttttagcggtccgtccgggtcctgacnggtcagtgcngtgatcgagcanagtatttacattagaaatcagacaggtagtgggagngtaggagatggtcgttagggttaacttttatacgtgtacagtacgactaaacgaaccttaaaaccgtaacctttccgtttaccacccggttacggaacccgtaaggacctacgacgtggaactagtacgaacgtacgtggtcggactcaccgtacctagttcctacg

SEQ ID NO: 148023 - DNA, 585 bp, Homo sapiens
  misc_feature: GYAE6OF02G4FSZ.47.87.H10.1.454.CMB.1.raw
  modified_base (199)..(199): a, c, t, g, unknown or other
  misc_feature (199)..(199): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcatcgttggagngccgctcatctcctgcaggtctagccagacgcctcctgcagactaagtggaaacttacctagtttggattcggtacctgaacaaacgccgaggcacgtcctccacactcagtactctagtttcgtacttttaacgccggtccgtccgggtcctgactacggttcacgtggacgtagtcgatcgaggcacgtagttatttacattaagaaactcagtcgaggagtaggacgtacgtagacgtagtcgcgttaggtatttagtacgtagtacgtagtagacgtaagtaacctaaacctaaccgttccttaccgtaccgttaccggacccgaacgggtaccaccgtacgtaggtaactacgttaacgaccgtaacgtcggtcgactacg

SEQ ID NO: 148024 - DNA, 702 bp, Homo sapiens
  misc_feature: GYAE6OF02G1PC5.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtcctccagtcctccctgcccgtcatcgttggagacgccggcctccatcctcctgcaggtctacgccagacgccctcctgcagactaagtaggaaactaaccttatttggattaggtacctagaccaaaagccgagggcacgtccaccaactaacctcctagacttcttagttcggtacttttaacgccgggtccgtccgggtccctgacgtgtaccacgtcggctagtcgactcgaggtccagtagtacttttacagtttaagaaactccgaagtacaaggtacggtagggaacggttcgttaacggacggtatacggtacggttaggtttaacgtttaattaccgtagttaccgtagttactaaccggtaaacgtaaccttaaaaacccgttaaacctttacccgtttaccgttacccggttacccgggaacccggtaacggggtaaccctaacccgggtaacggtaacccggtaagttaacggttaaccggtaaacccggtttaacggtaccggttacgggtcccttaaccggg

SEQ ID NO: 148025 - DNA, 538 bp, Homo sapiens
  misc_feature: GYAE6OF02GIVYS.47.87.H10.1.454.CMB.1.raw
  modified_base (323)..(323): a, c, t, g, unknown or other
  misc_feature (323)..(323): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaataccttattggattggtacctgacaaaagccagggcagtcctccacaactctgatctatttggcttttaancgggtcctccgggtccctgactggttcactggcagtggatcaggcacagattttacattagaaatcagacagagtaggaggctagacgatggcgttaggtagtttattacgtgcgtatgacaagtactaaaactaacttacccttctaccgttacgaccgtaaacgggaccaccggaacgtagacaacgttaaggacctaagtgtacggctaccg

SEQ ID NO: 148026 - DNA, 630 bp, Homo sapiens
  misc_feature: GYAE6OF02ISTFH.47.87.H10.1.454.CMB.1.raw
tcagagctcacgtacacgaccggtgctcgatttagcagtactgcgttgggtttgggggtgatcaggactcctcagttcaccttctcacaatgaggctccctgctcagctcctggggctgctaatgctctgggtctctggatccagtggggatattgtgatgactcagtctccagtcctccctgcccgtcatcgttggagagccggcctccatctcctgcaggtctagccagacgccctcctgcagactaagtaggaaacttacctatttggattacggtactgacaaaagccgagggcagtctccacaactcctgatcttatttcggtactttaacgtccgggtccgttccgggtccctagacgtacggttacacgtggactagtcggatcgaggcacgtagtacgtttacgactaagtaaactcgtaaggtaggggtaggtaggtcgtaggaggttagtttgggtttagggtttattacgtgtcgtagtcgtacgtacgtttacctaacctaaccgtttaccttaacgttacgtttacggaccgtaaggggtacctaagggtcgtagggaacgtacgtaaccgaaacggtacgttaggtacggtacctaccgaccgtaccgtattaccg

SEQ ID NO: 148027 - DNA, 791 bp, Homo sapiens
  misc_feature: GYAE6OF02ICMI5.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctctggatccaggtgggatagttgtgatgactcacgtctccacttcctccctcgcccgtccaccccgtggacgacgcccggcctaccatcctccgtgcacggtcacgccagaccgtccttcttacaagtaagtaagtaggtattaccaagtttatttagtaacgtttcggtaaccttggactaacggaaacggacccgaagggtcctaacgttcctaccgtaacacggcccttccgtggtacttccggtttggttttcgggttctggtaccgtccgggtccgtccggggtccctggacgtaggttcgaggtcgacgtacggtggtaacctcggacgacgtaacgtaacggttacgttttaccgaacgttaagtaaacgttacgggtaacgggtacggggttagggaacgggtaccggttaagggtaacgggttaggttttacggggtttttaacggggttttaacgttacggttacgttaccgtaacggttacggtaacgttaaaccgtttaccgttaaaaccttaaacccggtttaccttaaaccgtttaccggtttaccgggacccggttaacggggtaacccgtaacgggtacgttacgggaacgttaacgaaccgtaaacggtacggtacgtacggtaacgtccgtacccgtaacg

SEQ ID NO: 148028 - DNA, 228 bp, Homo sapiens
  misc_feature: GYAE6OF02H7D7R.47.87.H10.1.454.CMB.1.raw
  modified_base (222)..(228): a, c, t, g, unknown or other
  misc_feature (222)..(228): n is a, c, g, or t
tcagagctcacgtacacgaccggtgctcgatttagcagtactgcgttgggtttggggggccagggaaccctggtctccgtctcctcagcctccaccaagggcccatcggtcttcccctggcgccctgctccaggagcacctccgagagcacagcggccctgggctgcctggtcaaggactacttcctacgtgagctctgagcgggctggcaaggcgcatagnnnnnnn

SEQ ID NO: 148029 - DNA, 798 bp, Homo sapiens
  misc_feature: GYAE6OF02FVZD9.47.87.H10.1.454.CMB.1.raw
  modified_base (499)..(499): a, c, t, g, unknown or other
  misc_feature (499)..(499): n is a, c, g, or t
tcagagctcacgtacacgaccggtgctcgatttagcagtactgcgttgggtttggggtgatcaggactcctcagttcaccttctcacaatgaggctccctgctcagctcctgggctgctaatgctctggctcccagataccagatgtgacatccagatgacccagtctccattcctccctgtctgcatctgtaggagacacagtccaacctatcacttggccgggcgacgtcgacggacattagactaaatttatttagccttaggtactcgacgtacgaacgaaaacccgaaggggtaaaacgtttacccgtaaagtccttacccgtaggtaacttacgttaacttacggtttaaccaacctttaccctaacgttttcgtacctaaacggttttccgggggtacccctaagttcccgtttacgggttaccgtaggttcggtaccgtagggttacgggtaacgttcgtaacggggtaacgtaacggtttacgtttaccnccgtttacctacccgtaaccctagttaccaggtacctaaccggttccctggacccgtacgtcccgtaaggtaaacggttagtttacgtttacggtaacccctttaaagttttaacgtttaacgttaaccttaaacgtaaaaaacttttacgtaaaccgtacggtacccggtaccccgtacttaccccgttaacggttttccggggaaccggggtaaccggggtaaccgttaaacgggggtcggtaacgtaacgttaaccgaaaccggttaccgttggtacgggtccttacggaaccccg

SEQ ID NO: 148030 - DNA, 554 bp, Homo sapiens
  misc_feature: GYAE6OF02GPVE4.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtggggtccatcaaggttcagcggcagtggatcgtgggacagtatttcactctcactatcagcagcctgcacgcctagaagtatttttcggaacttttatttattagtactaacgtaagggttaactacgtttcccgactccgtacccgttcgggcgggaacgggaccgtaagggtaggagagtaggaaaacgtacgtaggtggctagccactattccgttggttccttcacttacccg

SEQ ID NO: 148031 - DNA, 223 bp, Homo sapiens
  misc_feature: GYAE6OF02I8OTE.47.87.H10.1.454.CMB.1.raw
  modified_base (220)..(223): a, c, t, g, unknown or other
  misc_feature (220)..(223): n is a, c, g, or t
tcagagctcacgtacacgaccggtgctcgatttagcagtactgcgttgggtttgggggccagggaaccctggtctccgtctcctcagcctccaccaagggcccatcggtcttcccctggcgccctgctccaggagcacctccgagagcacagcggccctgggctgcctggtcaaggactacttcctacgtggctctgagcgggctggcaaggcgcatagnnnn

SEQ ID NO: 148032 - DNA, 1111 bp, Homo sapiens
  misc_feature: GYAE6OF02HCYJQ.47.87.H10.1.454.CMB.1.raw
  modified_base (205)..(205): a, c, t, g, unknown or other
  misc_feature (205)..(205): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctccgtggtctcgtggtactccgaggtgggattagttggtgtatcgactcgtacgtcctccagttcctcctcggtcccgtntacgttcggttaggaggccggtccccggtccttaccctattcccgttccgtacggtacgtacgggttaccgtaaccggaccgaaggtaaccgtccccttccgtaggaccgaacggttaaaaccgttaaacgtaagggttaaaaaccttaacccgttttaaggtttacggtacggtttaccggttaacccgtacgaaaaccgtaaaacccgggaccgggacgggtaccgtaacggttaccccttaaccccaaaacccgttaaaccccgtttccggtaacggttaacctttaccgttttaacgggtttttacggttttaaaccccggttttttaccggggtaccccggggggtttccccccggttttacccccggggtttaccccgttaacgggtaacccggtttacgggtttaccgtaacggggttaccgggtaaccggttaagggttacggggtaaacgtttacccgggaagggtacccgtaacggtttaaacgggttttaaacccttttaacccgggtaccgttaaaaggttaaaaacggttccgggtttaaaacgggggttacggggggttaacggggtaacggttcgggttaaaggggttaagggtttaacggttttaagggggtttttttaacgggggtttaaaccttttaacgggtacgttaacccggttaaggttaaccgttaaaccgggtttaaaaccgttttacccgggtaaaaccttttaacccgtttttaaaccccgtttaacgttttacccggttttaaccgggaaccgggtaaacccggggtaacttaaacgggtaccgggttaaggtaaaccgttaaacgtaaacccggaaaccggttacggtttgggtaaccggtaccttacgggaaccccttaacggtaccgtttaaccgg

SEQ ID NO: 148033 - DNA, 761 bp, Homo sapiens
  misc_feature: GYAE6OF02FPF6U.47.87.H10.1.454.CMB.1.raw
  modified_base (235)..(235): a, c, t, g, unknown or other
  misc_feature (235)..(235): n is a, c, g, or t
tcagagctcacgtacacgaccggtgctcgatttagcagtactgcgttgggtttgggctcagttcaccttctcacaatgaggctccctgctcagctcctggggctgctaatgctctgggtctctggatccagtggggatattgtgatgactcagtctccagtctccctgcccgtcatcgttggagagccggctccatctcctgcaggtctagccagacgcctcctgcagactaagngaaatacctattggattggtacctgcaaagccaggcagtctccacaactctagactctagtttggtacttttaagccgggtccttaccggggtccccttaggaccgtacgggttcctaacgtcggtacgtacggttagggacgttccgtaacggcctaacgtaacggttacgtttttaaaccagttttaacgggtaaaaacttccgtaaaggtacccgtaaggaaggttacggggtaaccggtacgtttacggggaaaccggtaacgttacggtccggtttaacggggttaacgtttttaacgtttaaaccgttcggtaccttaacggttacggttaaccgtaaaccggttaaccgttaaaaccgtaaaaccgtttacccgtttaaccgtaccccggtttaacggtacccggaaacgggtaccgtaaccggtacggttaaccgggtaacgtaacgttaacggtaaccgtaaccggttacggttacggaccgttacgggtacctacccgttagttaccgtttaccgg

SEQ ID NO: 148034 - DNA, 738 bp, Homo sapiens
  misc_feature: GYAE6OF02GQH5M.47.87.H10.1.454.CMB.1.raw
tcagagctcacgtacacgaccggtgctcgatttagcagtactgcgttgggtttgggctcagttcaccttctcacaatgaggctccctgctcagctcctggggctgctaatgctctgggtctctggatccaggtggggatattgtgatgactcagtctccactctccctgccccgtcacccctggagacgcccggcctccatcctcctgcaggtctagccagacgccttacttacattaacgtaagtggtattactaacttatttgaattcggtactgacaaagccaggcagtcaccacactctagattctattgtactttagccggtccgtccgggtcctagacgtacggttacacgtggacgtaggtcggtactcgacggtacaactagttaacttttaacgtaattaagaaaactcgaagtacgaaggtagggtacgggaaggtcgttaacgggaacgtaggttacggaccggtttagggttaaccgttttacgttaaccgtcggtaccgttagtaccggaacgtaaaccgttaaccgtaaaacccgtttaccctttacccgttttaacccgtaaccgtttcccggggaaaccttaaaccggggtaccgtaaccggttaccgttaacggaaccggtttaaacgttaaccggtaaaccgttaaccggttaggtcccgggttaaccttacccggtaaccgttaacccgtaccggttttaccgttaccggtttaacccg

SEQ ID NO: 148035 - DNA, 655 bp, Homo sapiens
  misc_feature: GYAE6OF02HRQA8.47.87.H10.1.454.CMB.1.raw
  modified_base (336)..(336): a, c, t, g, unknown or other
  misc_feature (336)..(336): n is a, c, g, or t
  modified_base (469)..(469): a, c, t, g, unknown or other
  misc_feature (469)..(469): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagagctcacgtacacgaccggtgctcgatttagcagtactgcgttgggtttggggactgatcaggactcctcagttcaccttctcacaatgaggcctccctgctcagctcctggggctgctaatgctctgggtctctggatccgaggtgggatattgtgatgactcagtctccagtcctccctgtcccgtcagttcgtgggacgacggcccggtcctccatcctcctgcgtagtctagccagccgcctctgcagaactaagtaggaaactacctagtttggtattcggtactagactaaaacgccgaggctagtcctacctaacaaccgttccngtaactcttagtttcggttacttttaacgtccggggtccgttcccgggggttccctggtaccgtacggtttacaacgtcgggcgtaacgtggacttccggacgtctaacgtagttacttttaacagtttaaanaaaacgtgtaacgacgtaggaggtggaacggtcgagtaccgtgtgtacgttaggttaacgtttattacgtnacgtanacgtacaacgtacaaaaccttacgttacccttaccgtaccgtaccgggtacgaacggtacgaccggtacgtacgacgtaacgttacggaaccgtacgtagcggttaccg

SEQ ID NO: 148036 - DNA, 693 bp, Homo sapiens
  misc_feature: GYAE6OF02JNR57.47.87.H10.1.454.CMB.1.raw
  modified_base (187)..(187): a, c, t, g, unknown or other
  misc_feature (187)..(187): n is a, c, g, or t
  modified_base (246)..(246): a, c, t, g, unknown or other
  misc_feature (246)..(246): n is a, c, g, or t
  modified_base (475)..(475): a, c, t, g, unknown or other
  misc_feature (475)..(475): n is a, c, g, or t
tcagagctcacgtacacgaccggtgctcgatttagcagtactgcgttgggtttggggtggatcaggactcctcagttcaccttctcacaatgaggctccctgctcagctcctgggctgctaatgctctgggtctctggatccagtggggatattgtgatgactcagtctccagtctccctgcccgtnactcgttggagacgcccggcctccatcctcctgcgaggtctagccagagccctctgcanactaatggaaacttaccttatttggagttcggtacctgacaaaacgcacgggcagtcctaccactaacctcctgattctagtttcgtacgttttaacgccgggtcccggtcccgggtccctgaccgtaggttcacgtcggactaggtggacgtccgaggctaacgagttaactttacgtacttaagaaactgtacgacgtagacgggtagtacgggattcggaacggtnttcggtacgttaagggtttaccgttttaatttaacggcgtaacgtacggttaagacgttaaaccgaaactttaaaaacccgtaaccgtttcccgtttaacccgttaccccggttaaccgggtacccgtaaaaccggggtactaaccggtaacccggttacggaacgttaaacgtttaacgggaaccgtttaaaccggttcggtaccggtacgttaccg

SEQ ID NO: 148037 - DNA, 825 bp, Homo sapiens
  misc_feature: GYAE6OF02I7J4P.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctcgtggatccaggtggggatagttgtgatgactcagtctccagtcctccctggcccgtcattcggttggagacgccggcctccatctcctgcaggtctagccagacgcctctgcagaactaatacggtaaaacttaaccttagtttcggtagtttacggtacctagtaacgaaaacggcccgagggccacgtccacccaacctaacgtcctagtacttcttagttttcggttacttttaacggtccgggtcccggttacccgggtccctacggtaacgttacggttcgacggtcggacgtagggtacgtacgtaccggaggtccgaacgtaacgtttaagttttaacgtaaacgtttaaaggtaaaaacgtcgaacggtacgtaagggtacgggttaaggggagggttaaccgttacgggtaacgttacggtcggttacgggtttcggtttaaacggtttttaacgttaacggtacggttactaacgggttacgtaaaccgttaaacggtaaaccctttaaaaacgttaaaccccgttttccgttttaacccgaaccccgggttttaaccgggaaacccggtaaaaccggggtaacccctaacgggtaaacccggttaccggtaaaccgtttaacgggttaaccggttaaaccgggttaaccgttcggggttaaccggcccggtttaaccgg

SEQ ID NO: 148038 - DNA, 525 bp, Homo sapiens
  misc_feature: GYAE6OF02H9SQR.47.87.H10.1.454.CMB.1.raw
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (521)..(521): a, c, t, g, unknown or other
  misc_feature (521)..(521): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtctccctgcccgtcatcgttggagacgccggcctccatctcctgcaggtctagccagagcctcctgcagactaatggaaatacctatttggattggtacctgacaaaagccgagggcagtctccacaactcctgatctatttgcttttaatcggcctccgggtccctgacaggttcacgtggcagtggatcaggcanagtatttacaattnaaatcagcagagtgaggtctagacgatgctaggtactttattacngtanagtgacaacgtactaaaacgtaacttccttacgaccgttcggaaccgaaggacacgacgtagaactagttacgaaccgtatcgtacgntacg

SEQ ID NO: 148039 - DNA, 670 bp, Homo sapiens
  misc_feature: GYAE6OF02GMTTB.47.87.H10.1.454.CMB.1.raw
  modified_base (188)..(188): a, c, t, g, unknown or other
  misc_feature (188)..(188): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccaggtggggatattgtgatgactcagtctccagtctccctgcccgtnatcggtggagacgccggcctccatctcctgcaggtctagccagacgcctcctgacaagactaagtaggaaaacttaccttagtttggaattcggtacctagaacaaaacggccgaagggctagtccaccaactaactctagattcttagtttcgtacttttaagccgggtccgtccgggtcctagactaggtcacgtgctaggtcgatcggaagcaacgtagttaactttaactaatttaacgaaaatcgagacgaagtaggtagggtaggacgttacggaacggtgttcggtacgttagggttaacgtttttaagttaccgtagtaccgtaagttacgaacgttaaacgtaacctaaaaacccttaaccgtttacccgtttaaccgtacccgtaccgggtaacgaaacgggtaacaaccggttaacgtacggtaaccgtaagttaaccggaaaccgttaacggtcggtacgtacctaacgg

SEQ ID NO: 148040 - DNA, 604 bp, Homo sapiens
  misc_feature: GYAE6OF02IFF88.47.87.H10.1.454.CMB.1.raw
tcagagctcacgtacacgaccggtgctcgatttagcagtactgcgttgggtttggggtgatcaggactcctcagttcaccttctcacaatgagctccctgctcagctcctggggctgctaatgctctgggtctctggatccagtggggatattgtgatgactcagtctccactctccctgcccgtcacccctggagacgccggcctccatcctcctgcaggtctacgccagacgcctctacatagtaatggattcaacttattgaattggtacctgcagaacgccgaagggctacgttcctaccgacacgccttacctgacttcgtttggtttcgggtctgacgtccgggtcccttccggggtccctgactaggttcaggtgactaggtcgatcgaggcacgtagtaactttcgactaagtaagtcgtaggtagggtggaggtcgtggtaggtgttggtttagggttattacgtgtgtatcgtacgttaagttaccttaactaaccgtttacctacgtttacgtttacggaccgtaagggtaccgtaacggtactgggtaacgacgtacgaaacgtacgtaggtcgtactacggtacctaaccg

SEQ ID NO: 148041 - DNA, 662 bp, Homo sapiens
  misc_feature: GYAE6OF02IBOUW.47.87.H10.1.454.CMB.1.raw
  modified_base (254)..(254): a, c, t, g, unknown or other
  misc_feature (254)..(254): n is a, c, g, or t
  modified_base (438)..(438): a, c, t, g, unknown or other
  misc_feature (438)..(438): n is a, c, g, or t
  modified_base (550)..(550): a, c, t, g, unknown or other
  misc_feature (550)..(550): n is a, c, g, or t
  modified_base (655)..(655): a, c, t, g, unknown or other
  misc_feature (655)..(655): n is a, c, g, or t
tcagagctcacgtacacgaccggtgctcgatttagcagtactgcgttgggtttggggtgatcaggactcctcagttcaccttctcacaatgagctccctgctcagctcctggggctgctaatgctcgtgggtctctggatccgagtgggatattgtgatcgactcagtctccgagtccttccctgcccgtctagttcggttgggacgacggcccggccctccgacttcctccgtgcgtaggtctacgccagacnccctctgcagtaactaagtacggaaacttaacgttgtttaggacgtttcggtaaccgtgaacgtaaaacgccggtaaggtacctacggtcctaccaactacctccgtagtacttcttagttttacggtcttttacggccgggtccggtcccggtcctagacgtacgttctacgtcgacgtggtntatcgagactactagttactttaacgtattaaagaactcgacgtgacggtaggaggcgtacgtggacgtatcggtcgtagggttacttaacttgtcgatagtgaaccttaanaacctaaactaaccgtttccttaccgaccgtttaaccgggacctaaacgggtacaaccggtacgtaacgtaacgttagtaccggaacgtacggtcggtaccggtntacccgg

SEQ ID NO: 148042 - DNA, 672 bp, Homo sapiens
  misc_feature: GYAE6OF02I1ET6.47.87.H10.1.454.CMB.1.raw
  modified_base (482)..(482): a, c, t, g, unknown or other
  misc_feature (482)..(482): n is a, c, g, or t
  modified_base (524)..(524): a, c, t, g, unknown or other
  misc_feature (524)..(524): n is a, c, g, or t
tcagagctcacgtacacgaccggtgctcgatttagcagtactgcgttgggtttggggtgatcaggactcctcagttcaccttctcacaatgaggctccctgctcagctcctgggctgctaatgctctgggtctctgatccgagtgggatattgtgatgactcagtctccactctccctgcccgtcacccgtggacgacgccggcctccaatcctccttaggttacgtacctacgcccagacgtacccttctaacgtaaattaggtaataggtacttactaatttatttagaattcggtaacctgacaacggaagccgaggactacgtaccgtccaacgtcgcctcctgtattcgtttcggtttggttacgtgaccgtccggtcccggttccggggtcctgacgttggttcgacggtgacgtgtacggatcgtaggacacgtagtacgtttacagtaacgtaagtggtaaggtaggggtaggnggtacgtagggaggtcgtttagggtttcggtttaatacggtntacggtataacgggttactaacgttactaaccgttaaaccgttcttaacggttacgtttaccggacgggtaacgggactaaccgggtgtacggaaacgtaactaacggtaaccgtaagtcgggtagtacgtacaccggactttaaccg

SEQ ID NO: 148043 - DNA, 645 bp, Homo sapiens
  misc_feature: GYAE6OF02JAEYA.47.87.H10.1.454.CMB.1.raw
  modified_base (185)..(185): a, c, t, g, unknown or other
  misc_feature (185)..(185): n is a, c, g, or t
tcagagctcacgtacacgaccggtgctcgatttagcagtactgcgttgggtttggggtgatcaggactcctcagttcaccttctcacaatgagctccctgctcagctcctgggctgctaatgctctgggtctctggactccaggtggggatattgtgatgactcagtcctccagtctcctgcctnatcgtgagcgccgctcatctctgcaggtctagccagacgtcctcctgcagtactaagtaggaaacttactagttggattcggtacctagaacgaaaacgccgaaggtctacgtcctaccgactaactcctagacttacgtagtttcggtaccttttaacggccgggtacccgtcccgggtcctacgaacgtacgtttaccacgtggacgtagtcgaagtacgaggactacgtaagttactttacaagttaagaaaactcgtaagacgtaggtaggtaggacgtacgtagtacgtacgtcgtacgtaggttaacgttttataaccgtgtaccgtagtacgaactaaacgtaacctaaacgtaccgtttaccgtaccgtaccgtttaccggaacgtaacggtaacctcgaacgttacgaacgtaacggttacggaaaccggtacttaggtacgtccgtaacg

SEQ ID NO: 148044 - DNA, 1026 bp, Homo sapiens
  misc_feature: GYAE6OF02HWGPD.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctccgtgggctgctaatgctcgtgggtctctggatccaggtggggattgttgtgatgactcagtctccagtcctccctcgcccgtctacgttcggttaggaacgcggcccggtccctcctacttccctccgtgacgtacgggtctacgccaggtacgccctccgtgcaagaacttaagtaacggtaaaacttaccgtttaagtttagggtacgtttacggtaacccgttaggaaaaccgaaaaaccggcccggtaacgggtaccttaaccggttaccacccgtaaccgaccgtaccgttaccgttagttacgttcgttttacggggtttttcggttacgtacggttacccggcccggggttcccgggtttaccccgggggttacccgtacggtaaaccgggtttacggtttaccggtaagggttcgggtacggtaacgggttaccggggttacgtaaccgggacgggtaaccgttaaccggtaaggttttaacccgttttttaaccgggaaccgtttaaaagtaaaaaccggtttacgggtaaacggggtttaacgggggggttacggtaaaccggggtaggtttaaacggggttaagggtttacgggttttaaacggggggttttttttaacggggtttaaacgtttcccgggttaacggttaacggttaaccggtaccgggtttaaaaccgtttaaccgtttaaaccggttttaaaccctttaaaaacccgggttttacccttttaaaccggttttaacccggggtttttaccgggaaccggggtttaaaacccgggggtacggtaaaaccgggttcggttaaccgggtaaaaggtttaacccgtaaaaaccggttaacccgggtaaaacggtttccgggtttaaagggtcccgttaccgaccgttttaaaaccccgg

SEQ ID NO: 148045 - DNA, 605 bp, Homo sapiens
  misc_feature: GYAE6OF02IDACC.47.87.H10.1.454.CMB.1.raw
  modified_base (428)..(428): a, c, t, g, unknown or other
  misc_feature (428)..(428): n is a, c, g, or t
tcagagctcacgtacacgaccggtgctcgatttagcagtactgcgttggggtttgggggtgatcaggactcctcagttcaccttctcacaatgaggctccctgctcagctcctggggctgctaatgctctgggtctctggatccaggtggggatattgtgatgactcagtctccagtctcctgcccgtcatcgtggagacgccggtcctccatcctcctgcgtaggtctacgccagacgccctctgcagactaagtaggaaactacctatttggattggtactgacaaaagccgaggctacgtctaccactactcctgactctagtttgtcttttaagtccgggccgttccgggtccctgacgtacggtactagtcggctaggtgatcgagactacgtagtatttacattttttaagaaatacgaganaggtaggtaggaggacgtgacgtagtcgtcgtaggtagttattacgtagtactagtgactaacgtaactaaacctaaaccttaccttacctacccgttaccggtaccgtaacgggaaccgtaaccgtaacgtacggtaacgtacgttacgtaccgtaacgtaggtacggtcgtaccg

SEQ ID NO: 148046 - DNA, 658 bp, Homo sapiens
  misc_feature: GYAE6OF02HHBOY.47.87.H10.1.454.CMB.1.raw
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (479)..(479): a, c, t, g, unknown or other
  misc_feature (479)..(479): n is a, c, g, or t
  modified_base (564)..(564): a, c, t, g, unknown or other
  misc_feature (564)..(564): n is a, c, g, or t
tcagagctcacgtacacgaccggtgctcgatttagcagtactgcgttgggtttggggtgatcaggactcctcagttcaccttctcacaatgaggctccctgctcagctccgtgggctgctaatgctcgtgggtcctcgtggactccgaggtggggattattggtgacttgactcgacgtcctccacgttccctcccgtcgaccccgtccaccccgtggacgacgcccgcctccatcctctcgctaggtctagccagacgtcctctacatagtacgtggtacttacaacgttntttacgaagttcggtacctgacgaaggaagcccggagggtcaacgtcccacctagacgtccgtccatcttgttacggtttggttacnggcggtccggtccggtccggtacngtacgtgtcgnggtcggtacgtgacncgagtacngtagttactttacgagtaacgtaagtcggtaggtagggtagngtacgttaggtacggttaggttgggttttaacggttatcggtcgtagtagtcgtaattaaccgtaacttaccttaaacccggttntaaccggttcgtacggtacccggaaagggtccctagggtccggttaagaacgttaccaaacgggtaactgtccgggtaggactccgtaacttac

SEQ ID NO: 148047 - DNA, 796 bp, Homo sapiens
  misc_feature: GYAE6OF02HEBAA.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctcgtggactccgaggtggggtatagttgtgatgactcgacgtctccactcctccctgccccgtccacccgtggacgacgcccggcctccgactcctccgtgcgtacggtctacgccagacgtccttacttaacagttaagttaagtggtaacttacctaaatttaagtttacgtaagtttcggtaacctggacgaacggaacgcccggaagggtacctacgttacccctacccgaacgtacgtccttcccgtgtacgtttccgtttgggttttcgggttccgtaggtcccgggttccgggtaccccggttccccgggggttacctacggaaccgtttgggtacgtacgggtcggtaacgtgggtacggtacgtcgaacggtacacgtagttacgtttaccgaacgtaagtaacgtacggtaagggtaggggtacggtaggtcggttaggtagggttaagggttttggggtttaacggttttataccggttagtacgttagtacgttacgttaccgttaacgttaacccttaaaccgtttcctaacgtttaccgtttacgggaacccgggttagggaacccgtaaggtaccggttaaggtacccgttaacgtaaaccgtaaacgggttaccgttagggtaccgtaccgtacggaccttaacccgg

SEQ ID NO: 148048 - DNA, 711 bp, Homo sapiens
  misc_feature: GYAE6OF02FGO1E.47.87.H10.1.454.CMB.1.raw
tcagagctcacgtacacgaccggtgctcgatttagcagtactgcgttggggtttggggaggactcctcagttcaccttctcacaatgaggctccctgctcagctcctggggctgctaatgctctgggtctctggatccagtgggatattgtgatgactcagtctccactctccctgccccgtccaccccgtggagacgccggtcctccatcctcctgctaggtctacgccagcgtccttacttacattagtaagtggtacttcaacttagttagtaattcggtacctgactaaggaacgtcccggagggctacgttcctaccgacgacgtcctaccgtgtacgttcgtttggtttgggttactggtacgtccggggtcccgttccgggggtacctggtacgtcggttacgaggtcgcgtaggaggtactacgtacggactacgtagttacgtttacgtactaggtaaacgtacgtaagggtagggtacgggtacggtacggtagaacgggttaggtttaagggttttaggggttttaactttacggtcgttacgtaagttcgtaacgttaacgttacgtaaaccgtttaacgttacccttacgttacgtttacggacggtacggtaaccgtacgtacgaacgggtaacgacgtaaccgtaaacgtacgtacggtacggtacgtaccgaccggtactaccgttcgttaccgg

SEQ ID NO: 148049 - DNA, 688 bp, Homo sapiens
  misc_feature: GYAE6OF02JYVQ7.47.87.H10.1.454.CMB.1.raw
  modified_base (522)..(522): a, c, t, g, unknown or other
  misc_feature (522)..(522): n is a, c, g, or t
  modified_base (541)..(541): a, c, t, g, unknown or other
  misc_feature (541)..(541): n is a, c, g, or t
  modified_base (549)..(549): a, c, t, g, unknown or other
  misc_feature (549)..(549): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctcgtggtctctggactccaggtgggatagttgtgtatgtactcgagtctccagtcctcccgtcgtcccgtctacgttcggttagggacgacggcccggtccctaccacttcccgtccccgactacgggttccgtaacgcccgtaacggacgtccctccgtcggccgtaagtaacctaagtacggtaacttaaccgttagtttaggtacgttacggtacccgtagaaccgaaaagcccgtagggtactacgtcctaccaactaccgtactctagttcttagttcggttactttacggtcccgggtccgttaccgggtctacggtactacgtacgtacggtcgacgtaggtcggactggacggacctagtacttaagtttactaagtaagtaactcgancgtagaggtgtagcgtagntacgtcgngttagactttagtacgtgacgtaatcgaacgtacgtaaactaaccgttcctaccttaaccttcgaccgacggtaacggtaccacggtacgtacgtttaacgtagtaacgacggttaactcgggtactacgtccgaaccg

SEQ ID NO: 148050 - DNA, 785 bp, Homo sapiens
  misc_feature: GYAE6OF02HHG5C.47.87.H10.1.454.CMB.1.raw
  modified_base (189)..(189): a, c, t, g, unknown or other
  misc_feature (189)..(189): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattggtgatgactcagtctccagtcctccctgcccgtnattcggttggacggagcccggcctccattcctccgtgcctaggtctaacgccagacgccctcctgcagaactaagtaggaaacttaccgttattaggtagttcggtacctgaacgaaaacgcccggagggctacggtcctacccgaacctacttcctagtacttactttagtttacgtaccttttaagtccgggtaccgttcccggggttccctggtaccgtacgtttccgaacgttcggacgtagtaggtactcggacgacctagttagtagtttgacttaaagttacgtaaactcgtacgacgtaaggtagggttacggacggtacgtaacgggtaacgtaacggttggtaacggttagggtttaacgttttaacgttaccgtaggtaccgtaagttacggtaaccgtaaacggttaaaaccctttaaaacccgttaaccgtttaaccccgttttaccggttaaccccggttacccggtaaacccgggtaaaacggggttaacctaacccccggttaaggttaccgggtaaacccgtttaaacgggttaaacccggttaaacccggttagggtttaccggtacggttaacccgg

SEQ ID NO: 148051 - DNA, 972 bp, Homo sapiens
  misc_feature: GYAE6OF02GARIE.47.87.H10.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagagctcacgtacacgaccggtgctcgatttagcagtactgcgttgggtttggggtgatcaggactcctcagttcaccttctcacaatgaggctccctgctcagctcctggggctcctgttgctctggttcccaggttccagatgcgacatccagatgacccagtctccattcttctgtgtctgtcttctgtagganacagagtccaccatcacttgcgggcgagtcgagggtattagacgtaacgtggttacnccgtaggttaataccgaaacgaacggaaaaccgaacggggaaaccgtacccccccttaaaccgtccctactaacttcctacctactacgacctactacctacgttttacgaccgtaaagggttccgggtaccctaagttaccgtaaacgggtttcaacgggccggtaccggtaacgggttacggggtaactttaccggtagggggtaaaccctaaggtttaaccgtttttacccgaaccgtttacccttacccgtaaaacgtttaccgttacccgaaaacggttcccgtaaacgggttcccccgtttagggaccccgtaaaacgggttccccgtttaaaacgggttaaaacgttttacccgggtttttttaaagggttaaaaaccccttttttaggttttaacgtttttacccggggtaaaaccctaaaaaccggggtttaaccggggtttaaacccgttttaaacccggggttttacccccgtaaccccgtttaaaccgtttaaccccgggggtttacccgggggttaaacccggggtaaaccggggttaaaccccgggtaaaaggggggtttaacggaaaccggtttaaggtaaaacgggtaaaaaccgggttaaacggtttcgggtaccgggtaacccgttacggaaaccccgtaccgttaccgtttaaggtttccccgggtttactttacccgtaacccgttttacccccgg

SEQ ID NO: 148052 - DNA, 752 bp, Homo sapiens
  misc_feature: GYAE6OF02JZFRI.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctctggatccaggtgggattatgtgtatgactcagtctccagtctcctgcccgtcagtcgtggaggacgccgcctccatcctccgtgctaggtcctacgccaagcgcctcctggcaagtactaagtacgaaacttaccgttagttcggtattcggtacctagtaaccaaaacgccgaacggctacgtcctaccgaactaacctcgtagtacttcttaagttcggtacgttttaacgccgggtcccgttacccgggtcctaggtaccgtacggtttacgaaccgtggtacgtacgtaggtaccttacggaacggtacctaacgttacgtttaacgtttacgaaacgttaagtaaaacttccgaacggttacgtaacgggtaaggtcgggtaacgtacgttaacggaaacgtacggtacggtaccgttaaacgggtttaattttaaccgtagttacgtaaccttacgtacggaacttaaacgtaaccgtaaaacgttaacccgtttaccgttaacccgttaccgtaccgggtaaccggtaaccggttacccgaaccggttaacgttaacggttaacctaacgtttaaccgggaacctacggttacggtacccggattacccgg

SEQ ID NO: 148053 - DNA, 778 bp, Homo sapiens
  misc_feature: GYAE6OF02JG68R.47.87.H10.1.454.CMB.1.raw
  modified_base (120)..(120): a, c, t, g, unknown or other
  misc_feature (120)..(120): n is a, c, g, or t
  modified_base (175)..(175): a, c, t, g, unknown or other
  misc_feature (175)..(175): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
  modified_base (538)..(538): a, c, t, g, unknown or other
  misc_feature (538)..(538): n is a, c, g, or t
tcagagctcacgtacacgaccggtgctcgatttagcagtactgcggttgggtttgggctcagttcaccttctcacaatgagctccctgctcagctcctgggctgctaatgctctggtctntggatcgagtgggatattgtgatgactcacgtctccagtcttcccgtgtcccgtnatcgttggagacgcccggcctccatcctccgngcgagttctagccagacgtcctcngcagactaagtagtaactaccttagttacgtacgttaggtacctcgaactaaacgccgtagggctacgtccaccgacctaactccgtagtacttacgtcgtttacgttaacgttttacgcccggtaccggttcccgggtccgtagtaccgtagtacgacgtcggtactaaggtcgtacgtacgacgtaactacgtaagttaactttacgaactttaagtaaactcgtaggtacacgggttaaggacgggtacggtctaacgttaacgtacgttcgtacggtttacggtttaacgttttacttaccgnggttacctaagttaaccgaaggttaacccgtaaaccgttaaaccgtttaacctttcccgtttaacccgttaaccggttaccgggtaaaacgggtacccgggtaaacgttacccgggttaaacggtaccgggttaaaccctaaacgggttaaacccggttaaacggttaaccggtttacgggtacggttaacccggtaccggtaacccgttttaaaccggtcccgttaacccgtttcccgg

SEQ ID NO: 148054 - DNA, 833 bp, Homo sapiens
  misc_feature: GYAE6OF02IGSAG.47.87.H10.1.454.CMB.1.raw
tcagagctcacgtacacgaccggtgctcgatttagcagtactgcgttgggtttggggtgatcaggactcctcagttcaccttctcacaatgagctccctgctcagctcctgggctgctaatgctctgggtctctggatcaggtgggatattgtgatgactcagtctccagtcctccctgcccgtactagttcggttgggagacggcccggcctaccatcctccgtgcgtacggtctacggcacgacgccctccgtgacaacgtactaaagtaggtaaaacttaccgttagttggtagtttacggtacctgaaactaaaacggccgaagggtctacgtaccctaccaactaaccttcctagtaactttcttagttttacggttaaccgttttaacggtccggggtcccgttccccggggttacccgtacgttaaccgtaggtttcctacgttcgggacgtaggtacgtacgttcggaacgtaccgtaacgtaacgtttaacgttttacggtaacttaaacgtaaaagtcgttaagggggttaacggggtacgggtacgggtagttagggtaacgggtttaggttttacgggggttttaacgggtttaactttaaccgtagttacggtaagttaccggtaaacgtaaccgtaaaaaccttaaacccgttaacccgttttaccgttaacccggttacccggttaaccggtaaaccggttaaacccgggaccgtaaccggttacgggttaaacgtaacggttaaaccggtaaccgtaaaccggttaggtaccgggtccggttacccgtaacgtacccggtaccttccggtttaaccg

SEQ ID NO: 148055 - DNA, 765 bp, Homo sapiens
  misc_feature: GYAE6OF02IL5CL.47.87.H10.1.454.CMB.1.raw
  modified_base (172)..(172): a, c, t, g, unknown or other
  misc_feature (172)..(172): n is a, c, g, or t
tcagagctcacgtacacgaccggtgctcgatttagcagtactgcgttgggtttgggctcagttcaccttctcacaatgaggctccctgctcagctcctgggctgctaatgctctggtctctggatccagtgggatattgtgatgactcagtctccagtcctccctgcccgtnatcgttggagacgccggcctccatcctctgcacggtctacgccagacgccctaccgtgcagaacctaaagtcggaaaattacctaattttggattcggtacctgacgaaaagccgagggcacgtactaccaccaactcctagacttacttagttttcggtactttttaaacgtccgggccgtttccccggggtcccctgtaaccgtaggttccacgtcggcgtacgtggaacgttacgaacgggtaccaacgtaaggtttaactttttaaccgaagttttaacggtaaaaaattacccgaggtaaacccgtaagggtaaagggtacggggtaacggtacctagggaaaccgtaagtacggtaccggttagggtaaacgtttttaacgttaaccgttggtacctaaagtttcggaaacgaaaccggtaaaccttaaaaaccttaaaccctttacccgttttaacccctacccgtttaaccggaacccggtaaacgggaccctaacggaccttaaggaaaccgttacgtttaaacggaaaccgtaaccgttaaggttccggaccgttacggaccctaaccctgttaccgttaccg

SEQ ID NO: 148056 - DNA, 747 bp, Homo sapiens
  misc_feature: GYAE6OF02JHRBX.47.87.H10.1.454.CMB.1.raw
  modified_base (106)..(106): a, c, t, g, unknown or other
  misc_feature (106)..(106): n is a, c, g, or t
  modified_base (165)..(165): a, c, t, g, unknown or other
  misc_feature (165)..(165): n is a, c, g, or t
  modified_base (188)..(188): a, c, t, g, unknown or other
  misc_feature (188)..(188): n is a, c, g, or t
  modified_base (621)..(621): a, c, t, g, unknown or other
  misc_feature (621)..(621): n is a, c, g, or t
tcagagctcacgtacacgaccggtgctcgatttagcagtactgcgttgggtttggggactgatcaggactcctcagttcaccttctcacaatgaggctccctgctnagctcctggggctgctaatgctctgggtctctggatccaggtgggatatgtgatgactnagtctcagtctccctgtcccgtnattcggttcggagtacgcccggtcctccgattccgtccttggacctagggtctacggacccaggaagtcccttccgtacaccgaacgtaacgtaaagtttacggaaaaacttaccgttaagtttcggtaagttttacgggtaacccttacgtaaccgaaaaaggtccggaacgggacctacggttacctacccgaacctaaccgttacccaggtacttaccgttaactttagtaacccgttttaaacggtcccggggtacccggttaccggggtcccttaaggaccggtacggtttacaacgttcgggactacggtcgttaacggcgacggactacgaggtttactttaacacgtttaaagaacttaccgaagcgagtacgggtagaacggtactaggaaccgtgtacgtagtcggtaatttacgtacgttanaccgtgtagaaccgtaagtaaaccgtaaaactacccgtttaccttacacccggtttaccggaacggtaaacggctaacggacttacggaaccttagtaaccgtacgtaccgttggttaccggtacg

SEQ ID NO: 148057 - DNA, 715 bp, Homo sapiens
  misc_feature: GYAE6OF02IWM9S.47.87.H10.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (691)..(691): a, c, t, g, unknown or other
  misc_feature (691)..(691): n is a, c, g, or t
  modified_base (709)..(709): a, c, t, g, unknown or other
  misc_feature (709)..(709): n is a, c, g, or t
tcagagctcacgtacacgaccggtgctcgatttagcagtactgcgttggggtttggggtgatcaggactcctcagttcaccttctcacaaatgaggctccctgctcagctccgtggggctgctaatgctctgggtctctggatccgaggtagggggtatattggtgatgactcagtcctctagtcctccngcccgtnctcggtggagcgccgtcctacactcctcgnggacaggtctacgacctaggactccctcgtagacgtaacgtaacgtaacgtaacgtaaaacttacgttaacgtttacggactttacgggaccctaggaactaaaaccggccggtaagggacctttaacgcccgtaaccgactaacccgtcgtaagtacttacgttagtttacggtacgttttaacgccgggtaccggttccggtcccgtagaaccggtaggttacctaggacggtactagggtacgacacggtacgaactaacgtgttaattacggtaattaagaaactcgagtaacgtagtcggtaaggcgtaacgtagacgtggtaacgttcgtaaggttacgttaactacggtatacgtaagtaacggtacctaaaacgtaaccttaaaacgtacccgttacttaaccgtacggtaccgaacggtaacggacctacggagttaacgacgtaacggtaaacncggtaacggcgtacggtntaacgg

SEQ ID NO: 148058 - DNA, 704 bp, Homo sapiens
  misc_feature: GYAE6OF02HQIO3.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccagtggggatattgtgatgactcagtctccagtcctccctgcccgtcattcggttggagacgccggcctccatcctcctgcaggtctagccagacgcctcctgcacgtactaaagtaggtaaaacttaccgttagtttggaattcggtacctgaaccaaaagcccgagggctacgttcctaccgaacctaacctcctgtacttcttagttttggtacttttaacggccgggtccgtcccgggttcctggactacggttcaccgtggacgtaggtagactacgacggtacacgttagtacttttaacaatttaacggaaatcgacgtacgtaaggtaggtagggacgtacggttacgacgttagtcgggtacgttaggttaacgtttagttaacggttacgtacgtaagtacggtaaccgtaaagtaaccttaaacccgttaaaccttttcccgtttacccgtacccgtttaaccggaacccggtaaacggtacccgtaacggtaaccgttacggtaacgtaacgttaacggaaccgttaccgtacgggtcgtaccgtaaccgg

SEQ ID NO: 148059 - DNA, 574 bp, Homo sapiens
  misc_feature: GYAE6OF02GEJM8.47.87.H10.1.454.CMB.1.raw
  modified_base (171)..(171): a, c, t, g, unknown or other
  misc_feature (171)..(171): n is a, c, g, or t
  modified_base (201)..(201): a, c, t, g, unknown or other
  misc_feature (201)..(201): n is a, c, g, or t
  modified_base (570)..(570): a, c, t, g, unknown or other
  misc_feature (570)..(570): n is a, c, g, or t
tcagagctcacgtacacgaccggtgctcgatttagcagtactgcgttgggttggggtgatcaggactcctcagttcaccttctcacaatgaggctccctgctcagctcctgggctgctaatgctctgggtctctggatccagtgggatattgtgatgactcagctcagtcncctgcccgtatcgtgagacgccgctcatcncctgcaggtctagccagagccctcctgcagactatcggaaatacctagttgagtcggtactggacaaagtccgagggcagtcctacgactacctcctgacttcctagttgtctttaacgcggtcccggtaccggtcccgtggactcggttcaacggtggcaggtgatccgagtcactaagtacttacgagttacgaaatcacgcagtaggtcggaagtcgtaggacgagtacggcgttaggtagtttaagtacgttgacctagtacgacgtacgaaccttaaacgtaaccttcttaccgtacgtaccggtaccgtaaggggactacggacctacggaactacgtaacgacggtaacgtcggtacggttnaccg

SEQ ID NO: 148060 - DNA, 695 bp, Homo sapiens
  misc_feature: GYAE6OF02HDJWW.47.87.H10.1.454.CMB.1.raw
  modified_base (227)..(227): a, c, t, g, unknown or other
  misc_feature (227)..(227): n is a, c, g, or t
  modified_base (333)..(333): a, c, t, g, unknown or other
  misc_feature (333)..(333): n is a, c, g, or t
  modified_base (366)..(366): a, c, t, g, unknown or other
  misc_feature (366)..(366): n is a, c, g, or t
  modified_base (628)..(628): a, c, t, g, unknown or other
  misc_feature (628)..(628): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctcgtgggtctgtggatccaggtgggatattgtgatgactcagtctccactcctcctgcccgtcaccccgtggagacgtccggcctcactctctcgcgacgtntacgccagacgccttcttaacagtaacgtaatggactttacaactttagtttagaacgtttcggtacctggactaagaacgcgtagggctacggttcctaccaacncgtccttacctgtacttcgtttggtttccggtnttaggtacgtccggtcccggttccggggtacctggtaaccgtagttcgaggtcggagtacggtgacgttcgaggtacacgttagttactttacgaagtaagtaacgtagtaggtagggtaggaacgttcggagggttaaggtacggtttggggtttttaaacgggttatttaacggcggtatacggtagttacgtaaacgtttacttaaacctaaccgtttaccgtaacgtttacgggtttcgaccgggaacgggttaaccnggtacggtaggtaacctaacggtaaacctaacgggtacgttccggtacggttactacacgttaaccg

SEQ ID NO: 148061 - DNA, 735 bp, Homo sapiens
  misc_feature: GYAE6OF02GDOWV.47.87.H10.1.454.CMB.1.raw
  modified_base (164)..(164): a, c, t, g, unknown or other
  misc_feature (164)..(164): n is a, c, g, or t
  modified_base (187)..(187): a, c, t, g, unknown or other
  misc_feature (187)..(187): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctctgggtctctggatccaggtgggatattgtgatgactnagtctccagtctccctgcccgtnatcgttggagagcccgcctccatctcctgcgaggtctagccagacgtcctccgtgctaagactaaatggaaaattacccttagtttaggatttcggtacctgaactaaaaacgccgaagggccagttccgtaccaaccaacttccgtagtacttacgtttaagtttcggttacctttttaaacggtccggggtcccgtttacccggggtccccttacggtaaccgtacgggtttccaacggttcgggacctaaggtacggggacttacggacggtactaacgtaaggtttaacttttaacgtaatttaacggtaaaaatcgaaggacctaagggtaacggtacgggacgttacgttaggaacgtactaggtacgttaggttaagttttaactacgttaccgataacgttacgaataaacgtaaaccctaaaactaacccgtttccctttaacgtacccggttccggaaccgtaaacgggacctaaccggtacgtaaccgggtaactaacgttaccggaaacgtaacggtttcggtacgtactaaccgg

SEQ ID NO: 148062 - DNA, 810 bp, Homo sapiens
  misc_feature: GYAE6OF02IE0WQ.47.87.H10.1.454.CMB.1.raw
  modified_base (150)..(150): a, c, t, g, unknown or other
  misc_feature (150)..(150): n is a, c, g, or t
  modified_base (187)..(187): a, c, t, g, unknown or other
  misc_feature (187)..(187): n is a, c, g, or t
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
tcagagctcacgtacacgaccggtgctcgatttagcagtactgcgttgggtttgggctcagttcaccttctcacaagtgaggcctccctgctcagctccgtggggctgctaatgctcgtgggtctcgtggactccgaggtgggatattgngatgactcagtcctcagtcctcccgtcggtcccgtanacgttcggtggacgtaccgggccccggtccttaccacgttcccgtaccggtgaaccgtaccgggttccacggcccaaggtccncccctttccgnggcaaacgtacgttaaaggtacggttaaaacttaccgttagtttaggtacgttcggtacgtacgtaacgaaacggtccggaggcctacgtccgtacccaaccgtaacgttcctaaggtcttacgttcgtttacggttacttttaaccggtccggggtacccgttccccggggttaccctacggtaccgttaccggttccaccgggttaggtaccgtaaggtcgtaaccgtacccggaagtaccgtaatagtttaacgttttaacgaacgttttaaacgaaactaccggtaacggtaaccggtaagggtggtaacgggacggtacggtacggtacgtacgtacggttagtttacggttacgtttaacgttcgttacgtacggtactaacgtaccgaaaccgttaaccttaaaccgtaacctttacccgttacccgttaccgtaaccgggaacgtaacccgacgtacggtaccgtaagactaaacggtacgtaccgtaacgtcgtcgacgtacacctaacgtcgtacctcg

SEQ ID NO: 148063 - DNA, 846 bp, Homo sapiens
  misc_feature: GYAE6OF02FKWVM.47.87.H10.1.454.CMB.1.raw
  modified_base (169)..(169): a, c, t, g, unknown or other
  misc_feature (169)..(169): n is a, c, g, or t
  modified_base (500)..(500): a, c, t, g, unknown or other
  misc_feature (500)..(500): n is a, c, g, or t
tcagagctcacgtacacgaccggtgctcgatttagcagtactgcgttgggtttggggtgatcaggactcctcagttcaccttctcacaatgaggctccctgctcagctcctggggctgctaatgctcgtgggtctcgtggatccgaggtgggatagttgtgatgtactnagttcctccagtcctcccgtgcccgtctagtcggttaggacgacgcccggtcctaccgatccgtacctgctacggtcctacggacccaggacctccttccgtgaaccgtagtaaacttaacgtaacggtaaaactttaccgtttaagtttacggacgtttacggtaaccgtacggaaacgaaaacggcccggtaacggggaccttacggttaccctaaccctaaaccgtaaccgttccgttacgtacttacgtttaagtttccggttaaccgtttaacggtccccgggttacccggttcccgggttaccctaggtaccgttaccggttccncggttacggtacgtacgggttcgaaccggttacggaaccggttacctaaacggttaacgttttaaccgttttaaaacgaggtttaaaaccgaaacgttcgtaaccgtaaggtaaggggtaaggttcggggaacgtccggtaacggtaccgttaggtacccggtagtttaacccgggtttaaatttcttaccggagtaccgtttaggaaaccgtaactaaacccgttaaactaaaacccgtttccttacccgtttacgacgtaaccggtaacggaacgtaccgtaaacgtcggtaagttaaccctaggtttaacccgaacggtacgtcgggttacgtaccctacggg

SEQ ID NO: 148064 - DNA, 763 bp, Homo sapiens
  misc_feature: GYAE6OF02GA49I.47.87.H10.1.454.CMB.1.raw
tcagagctcacgtacacgaccggtgctcgatttagcagtactgcgttgggtttgggctcagttcaccttctcacaatgaggcctccctgctcagtctccgtggggctgactaatgctcgtgggtctcgtggactcgagtggggattattgtgatgactcagtcctcctacgttcctcccgtcgcccgttactagttccgggttagggacgaccggcccggtacctccgtacttccttccgtcgcgtacggtctacgccagacgtcctctgacaagtaactaagtacgtaaacttacttagttggtacgttcggtacctagaacgaaacgccggaggtccacgtacctaccaactacctcgtagtattactttagtttacgttaacgtttaccgggtcccgggttcccgggttacccgggttaccctaggtaaccgttacggttactacggtcggacgtggttacgtacgtacgacggtactaacgttacgtttaacgttactaacgttaacgaactacgtacgagtaacgggtaggtacggtacggtacgtacggtaggtacgttacgggtagttaaacggtttagttttaacgtcgtacgtagtaacgtacgtaaagtaaccgttaaactaaccttaacctttacccgttcctaaccggtaccggtaacgaacggtacctacgacggttaccggtaactaacggtaaccggttaagtaccgttaggtacgtacgtaccgtaacgtcgttaacgttcgttacg

SEQ ID NO: 148065 - DNA, 891 bp, Homo sapiens
  misc_feature: GYAE6OF02FIT4W.47.87.H10.1.454.CMB.1.raw
tcagagctcacgtacacgaccggtgctcgatttagcagtactgcgttgggtttggggtgatcaggactcctcagttcaccttctcacaatgaggctccctgctcagctcctgggctgctaatgctctgggtctctggatccaggtgggatattgtgatgactcagtctccagtcctccctgcccgtcatcggtaggagacgcccggcctacccatctccgtgacgacggtctacgcctacggacgtcccttccgtagcaacgtacttaaagtacgggtaaaactttaccccgtttaagtttagggtaacgttttaccggggttaaacccttacggaaccccgtaaaaaaccggtccccggaaacggggttacccaacggtttccctaccccaaacccgtaaacctttcccgtacgtacgtttacctttaacgttttcgggttaacctttttaaacggtcccggggttaccccggttaccccggggtttaccctacggtacccgttacgggtttacccacggtcgggtaccgtaagggtacggtacgttaccgaacgggtctaaccgtaacgtttaacgtttttaacgaactttaacgtaaaacgttaccgacggtaccacggggttaacgggtacgggtaccggtacggttaacgggtaacccgttagttaccgggtacgtttaggggtttaacgtttttaacttaccgtagtaccgtagtacgtaaccgttaaacgtaaaccttaaaaccttacccgtttacccgtttacccgtacccggttaccggaaccggtaaaccggggtaaccctaaccggggtaaccgttaacggtaaccttaacgggtaacccggtaaaccgtaccgtacgggttacggtacccgttaaccgg

SEQ ID NO: 148066 - DNA, 1050 bp, Homo sapiens
  misc_feature: GYAE6OF02G9LPH.47.87.H10.1.454.CMB.1.raw
tcagagctcacgtacacgaccggtgctcgatttagcagtactgcgttgggtttgggctcagttcaccttctcacaatgaggctccctgctcagcctcctggggctgctaatgctcgtgggtctctggactccaggtgggatagttgtgactgactcgagtcctaccgagttccctccctcgtccccggttacacgttcgggttacggaggaccggccccggtcccttaccctacgttcccttcccgtggtaccgtaacgggttccgtaaccggacccgacgtaccggtccccttcccggttacgaccgtaacgaacgttaaacgtaacggttaaaacctttaccgtttaagttttacgggtacgttttaccggttaccgttacgaaaccgaaaaccggtaccggtacggggacctaacggttcccctaaccgtaacccctaaccgttaccggtaccgttaaccgttttcgttttaacggtttttcgggtttaaacccgttttttaacgggtcccccgggggtcccccgggttttacccccgggggttaccccgtttacgggtaacccgggtttaccggttaaccccgttacggggtacgggtacccggttaccggggttaacgggttacgtaacccgggtaacggggtaacctaaaccgggtttaaacgttttaaacggtttttaaaccgttaacggttttaaacggttaaaaacttcccggtaaagggtaccggtaaagggggttacgggtaccggggttacggtaacccgggttaggtaaacgggtcggtttaacggttaccggtttaaggttttaacgttttaaccgttacggttacggtaacgttacgtaacgttaaccgtaaacgtttaaacccggtaaaacccttttaacccgttttcccttaaacccgggttaccccgttaacgggaaaacccggtaacgtaaccggttccggtaaccggtaccggtaaggttaaccggtaacggtaaccgtacgtaacgggttctaacggtacctacccggttacttaccgttaccgttacg

SEQ ID NO: 148067 - DNA, 700 bp, Homo sapiens
  misc_feature: GYAE6OF02JGHDM.47.87.H10.1.454.CMB.1.raw
  modified_base (144)..(144): a, c, t, g, unknown or other
  misc_feature (144)..(144): n is a, c, g, or t
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (441)..(441): a, c, t, g, unknown or other
  misc_feature (441)..(441): n is a, c, g, or t
  modified_base (542)..(542): a, c, t, g, unknown or other
  misc_feature (542)..(542): n is a, c, g, or t
tcagagctcacgtacacgaccggtgctcgatttagcagtactgcgtttggggtttggggtgatcaggactcctcagttcaccttctcacaatgaggctccctgctcagctccgtgggctgctaatgctctggtctctggactcnggtgggatnttgtgatgactcagtctaccngtcctcccgtgacccgtctagttcggttaggacgacgcccggtccnccacgttcctcctagcgtacggtctacggccaaggcgtcccttaccgngacctaaggtaacttaagaagtaaaactcttagttacgagtttcggaactagaaccgaaacgcgaacggtcaacggttacccaccgaactaaccgtcgtacgtattactttacggttcgtacgtttacgcgggtcccgtccggacctagtactacggtacacgtgtacgtagnggacttacgagttacattagtaatttacgtaataacgaacgtagagacgttaggagtaagcggtagacgtagtaggcttcgggtagttaaagttccgttanaaccgttgacgtaacaacgttacggttaaaactaaacccttaaccgttccgtttaacccgaacggttcccgtaacgtaaaccgggacctaaccgggttaaacaccggtaagtttaacggaaccggtacgttaaggttccggttaacggcccgttaacg

SEQ ID NO: 148068 - DNA, 774 bp, Homo sapiens
  misc_feature: GYAE6OF02GQY0S.47.87.H10.1.454.CMB.1.raw
tcagagctcacgtacacgaccggtgctcgatttagcagtactgcgttgggtttgggggtgatcaggactcctcagttcaccttctcacaatgaggctccctgctcagctcctggggctgctaatgctcgtgggtctctggatccagtggggatattgtgatgactcagtctccactcctccctgcccgtccacccctggagacggccggcctccatcctccgtgactaggtcctacgaccaggacgtccttacgttaacattaagtaagtaggtaacttacctaaattatttagtaacgttacggtacccttggacgtaaggaacgccggaacggggtacctacgtcctaccaacgacgtccttccgtagtactttcgtttgggttttcgggtacgttggtacggtcccgggtacccgggttcccgggggttcctacggtacgttacggttacgtacgggtacgggtacgtaggtacggtaacgtaccggaacggacctaacgtaacgtttaacgtttaacggaacgttaaagtaaaacgttaggtaacgggtacggggtagggtacggtacggtagggtaaggttaggtttaggggtttaagggttttactaggtcgtaacgtagtaggttaacgtaacgtttaactaaaccgttaaacctttaccgttacgttaccgtttaccggacgggtaccgggtaacgaacggtacggtaacggtacgtaacgtaaccggtaaacgtaggttaccggtaggtacctacgacgtaaccg

SEQ ID NO: 148069 - DNA, 728 bp, Homo sapiens
  misc_feature: GYAE6OF02G33Q5.47.87.H10.1.454.CMB.1.raw
  modified_base (187)..(187): a, c, t, g, unknown or other
  misc_feature (187)..(187): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (498)..(498): a, c, t, g, unknown or other
  misc_feature (498)..(498): n is a, c, g, or t
tcagagctcacgtacacgaccggtgctcgatttagcagtactgcgttgggtttggggaggactcctcagttcaccttctcacaatgaggctccctgctcagctccgtggggctgcttaagtcgtcgtcgtcgggtctctaggactccgaggtgggatagttgtcgatgactcgacgtctccacttcncccgtgcccgtccgaccctggacgcggcccgtctacccgtagtcctcgtcgcgtacgtcacncgagctccttanccgtaanaggtaactgtacttacgaatttagtcgtaagttcggttacggtactaaacgacggtacccgtggaacctggttaacctcccgaagtccgtccttaccgnggttattcccggtttggttttcggaccttgggtaaccgtcggggtccccgggttcggtcccgtaggaaccgttggttacncgggttacncgtagggtacacgttcgacggacagtacgtttacgtacgtanaacgtaacgtagtacgggtaggtcggtacgtggtagggtagtcgggttagggtttacggtttacggtacgttcgtaggtaccgttagtaaccgttacgttaccgtaacgttaaccgttaccgttacgttaccgttcggtaccggtaagacccggttagcggtacggtactaacgttacgtaaaccggttagtacggttagcgtaccggttaggaccgttactcggttacc

SEQ ID NO: 148070 - DNA, 933 bp, Homo sapiens
  misc_feature: GYAE6OF02JDR7Z.47.87.H10.1.454.CMB.1.raw
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
tcagagctcacgtacacgaccggtgctcgatttagcagtactgcgttgggtttggggtgatcaggactcctcagttcaccttctcacaatgagctccctgctcagctccgtggggctgactaagtcgcgtcctgggtctacgtggactccgtaggtgggtattattggtgaatggtactcgtacgtcctacctaccttcccgtccctcggtcccccgttaccctaccccggtgggaaccggaccggccccggtcccttacccgtattcccttccgtggacctacggggttaccaccggaccgtaggtaccgtacccttacctttaacgaagtttaacggttaagtacggttactaacccgttaaatttaagtttaacggttaagtttccgggtaccttggaacccgaaggtaaccgccggttaaggacctacggtccacccgacncgttcccncgtacgttcttcggtttcggtttacgggttcgtacgggtaccggtcccgggttacccggttacccggggttcctacggtaaccgttagggttccgtacggtcggttagtaacgggttcggacgttaacggacggtaacgtaccgtttacgtttaacggtttaccgtaacggttaaacgtaacccggttagggtaaggggttacggggtaggtacgtacggttacgggtagggtttaccgggttttaggggtttacgggtttaattaccgggttaagcccggttaaagtccgttaaacccttaggtttaaaccccttacggttaacccctttacggttaacccgttttaccgggttacccgggaaccgggaaccgggtttaaccctacgggttaaggtaaacccgggtctttaaacgaaaaccccgggttaacgttttacgggtaccggtaccggtttccgaaccggtttaccctaacggg

SEQ ID NO: 148071 - DNA, 220 bp, Homo sapiens
  misc_feature: GYAE6OF01CXKY9.29.22.B11.1.454.CMB.1.raw
  modified_base (179)..(220): a, c, t, g, unknown or other
  misc_feature (179)..(220): n is a, c, g, or t
tcagatagagtactcacgaccggtgctcgatttagacgacagctcagggtcccggatcggtcttcccctggcaccctcctccaaggagcacctctggggcacagcggccctgggctgcctggtccaaggactacttcctacggtgagcgtctggacgcgggctggccaaggcgcatagnnnnnnnnnnnnnnnnnnnnnnnnnnnnnnnnnnnnnnnnnn

SEQ ID NO: 148072 - DNA, 169 bp, Homo sapiens
  misc_feature: GYAE6OF01BRK1N.29.22.B11.1.454.CMB.1.raw
  modified_base (167)..(169): a, c, t, g, unknown or other
  misc_feature (167)..(169): n is a, c, g, or t
tcagatagagtactcacgaccggtgctcgatttagacgacagctcagggcccatcggtcttcccctggcaccctcctccaagagcacctctggggcacagcggccctgggctgcctggaaggactacttcctacgtgagctctgagcgggctggcaaggcgcatagnnn

SEQ ID NO: 148073 - DNA, 168 bp, Homo sapiens
  misc_feature: GYAE6OF02HUHRG.29.22.B11.1.454.CMB.1.raw
  modified_base (167)..(168): a, c, t, g, unknown or other
  misc_feature (167)..(168): n is a, c, g, or t
tcagatagagtactcacgaccggtgctcgatttagacgacagctcagggcccatcggtcttccctggcaccctcctccaagagcacctctgggcacagcggccctgggctgcctggtcaaggactacttcctacgtgagctctgagcgggctggcaaggcgcatagnn

SEQ ID NO: 148074 - DNA, 690 bp, Homo sapiens
  misc_feature: GYAE6OF02I81X8.29.22.B11.1.454.CMB.1.raw
  modified_base (171)..(171): a, c, t, g, unknown or other
  misc_feature (171)..(171): n is a, c, g, or t
  modified_base (452)..(452): a, c, t, g, unknown or other
  misc_feature (452)..(452): n is a, c, g, or t
  modified_base (657)..(657): a, c, t, g, unknown or other
  misc_feature (657)..(657): n is a, c, g, or t
  modified_base (677)..(677): a, c, t, g, unknown or other
  misc_feature (677)..(677): n is a, c, g, or t
tcagatagagtactcacgaccggtgctcgatttagacgacagctcagggggagtcccagtcaggacacagcatggacatgagggtccccgctcagctcctggggctcctgctgctctggcctcccaggtgccagatgtgccatccagttgacccagtctccatccttcctntctgctatctgtaggacgacgagacgtctccgatcctacgtcggccgggaccacgtcgagggactagttagtaagtttattacgtccgttggttacagaccaagaaaccggaaggaaacccgtaccccttaaacgtctagacttaccgtacgctcgactaccgttcctattcgacctacgtcgggttaccgggttccctggttacggtccgaggccggacgcggacgtactcgggtagacgtaagttctttacgctacccactaaccgctaccgacgtacnccgttaccgctaaccggtacgacgttagtaagtacgttacggtaacgtacctttaaacttcgttaacgtaccgtataaccgttacggttacgtttaaaccggtaacccgttaccgttaaccgttacgtttacggtttaccgggaaccggtaacggtaagtaacggtggtaactaacgtaaccggaacgtacgttcggacgttacnggtaccctagtcctaccgtnttacctctacccg

SEQ ID NO: 148075 - DNA, 485 bp, Homo sapiens
  misc_feature: GYAE6OF01CN9SV.10.4.A04.1.454.CMB.1.raw
  modified_base (170)..(170): a, c, t, g, unknown or other
  misc_feature (170)..(170): n is a, c, g, or t
  modified_base (425)..(425): a, c, t, g, unknown or other
  misc_feature (425)..(425): n is a, c, g, or t
tcagcatagtagtgcacgaccggtgctcgatttagagtagtgatcagggggctgggcctcaggaagcagcatcggaggtgcctcagccatggcatggatccctctcttcctcggcgtccttgcttactgcacagcatccgtggcctctctgacctgactcagccaccctnactgtccgtgtcgccaggagagacagccaccattacatgctctggagaagcgttgagcgataaatttgtttcgtgtataaacagaagtcaggcagtcgcctgtgttggtcatctatcaaaatattaaagcggcctcaggggtccctgacgcgaatctctggcgcaagtctgggaccacaggcacgctgaccatcagtgtcgacccaggctgtggatgaggcagactattactgtcaggcgtaggactagtagcgngtgtgtagtttcggcggaggaccgaagctagccgtctaggtcacgccagctgcccctcgg

SEQ ID NO: 148076 - DNA, 495 bp, Homo sapiens
  misc_feature: GYAE6OF01A3UB7.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgagtttcggcggagggaccgaaggctggacccgtccgtaggtcacgcccaaggcctgcccccgtcgg

SEQ ID NO: 148077 - DNA, 550 bp, Homo sapiens
  misc_feature: GYAE6OF01AS4T5.10.4.A04.1.454.CMB.1.raw
  modified_base (239)..(239): a, c, t, g, unknown or other
  misc_feature (239)..(239): n is a, c, g, or t
tcagcatagtagtgcacgaccggtgctcgatttagagtagtgatcaggggctcgggcctcaggaacgcagcgatcggaggtggcctcagtccatggccatggatccctcgtcttcctcggcgtccttgccttactgcacagcataccggtggcctcctctgaccgtgactcagccaccctcgactggtccgtagtcgcccaggtagagtacaccgccaccgattacatgcctcgtgganaagcgttgagcgataaattggttcgtggtataaacgagaagtcgaggccagtcgcctgtgttggtcagtctatacgaaaattattaagcggtccctcgacgggtccctggacgcgaatcgtctggcgccgaagtcgtacggggaccacgaggcacggctggaccatcagtgtcgacccgaggctgtggatgagcagactattactgtcgaggcgtggacagtagcgctgtcgagtttcggcggagggaccgaacggcgtacggcccgtcctagggtccacggccccgaagggcctccggcccccgtacggg

SEQ ID NO: 148078 - DNA, 497 bp, Homo sapiens
  misc_feature: GYAE6OF01C4JIF.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaattgttcgtggtataaacagaagtcaggccagtcgctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacgagtagcgctgtgtagtttcggcggagggaccgaagcgtcggacccgtccgtaggtcacgacccaaggcctcgccccgtccgg

SEQ ID NO: 148079 - DNA, 600 bp, Homo sapiens
  misc_feature: GYAE6OF01C25QC.10.4.A04.1.454.CMB.1.raw
  modified_base (105)..(105): a, c, t, g, unknown or other
  misc_feature (105)..(105): n is a, c, g, or t
  modified_base (217)..(217): a, c, t, g, unknown or other
  misc_feature (217)..(217): n is a, c, g, or t
tcagcatagtagtgcacgaccggtgctcgatttagagtagtgatcgaggggctgggcctcaggaagcagcagtcggaggtgcctcagccatggcatggatccctntcttcctcggcgtccttgcttactgcacgagcatccgtggcctcctctgacctgactcagccaccctgactgtccgtgtcgcgaggagagacagccaacgagttacatgctnggagaagcgttgagcgtaataaatttgttcgtaggtaataaacagaagtcaggccagtcgccgtgtgttggtcagtctaatacaaaaatagttaagccggtccctacgacggggtccctaggacgacgaaatcgtcgcggacgacctaagtcgacgggaccacgaggccacgctacgaccatacagtcgtcgacccgaggcgtggtgatggaaggcaagtactaagttacgtgtacgaagggcggtagggaactaaggtacgcgacgtggtagtacgtttcgggacggtaagggaaccgaaggtacgtacggtaacccggtaccgttaacgggttaccgaacggtaccccgtaaagggtcctacccggtccccccgttacggg

SEQ ID NO: 148080 - DNA, 518 bp, Homo sapiens
  misc_feature: GYAE6OF01CX9N8.10.4.A04.1.454.CMB.1.raw
  modified_base (170)..(170): a, c, t, g, unknown or other
  misc_feature (170)..(170): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagaagcgttgagcgataaatttgtttcgtaggtaataaacagaagtcaggccagtcgcctgtgttggtcatctatacaaaatattaagcggccctgacggggtccctgagcgaatctcgtggcgccaagtctagggaccacgacggcacgctgaccatacagtgtcgacccaggctgtggagtgaggcagactattactgtcgagggcgtgggacgaggtagcgcgtgtgtagttttcgggcggacgggaccgaagcgtcggaccgtccgtagtcgacgacccgaacggctccgccccgtcgg

SEQ ID NO: 148081 - DNA, 517 bp, Homo sapiens
  misc_feature: GYAE6OF01DU02A.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccagggagagacagccaccattacatgctctggagaagcgttgagcgataaatttgttcgtggtataaacagaagtcaggccagtcgcctgtgttggtcatctatacaaaatattaagcggccctgacggggtccctgagcgaatctctggcgccaagtctgggaccacaggcacgctcgacatcagtgtgacccaggctgtggatgaggcagactattactgtcgaggcgtgggacgtagtagcgtcgtgtgtagtttcgggacgggagggaccgaaggcgtcggaccggttaccgtaggtcgacgacccgaaggccgtcgcccccgttccgg

SEQ ID NO: 148082 - DNA, 525 bp, Homo sapiens
  misc_feature: GYAE6OF01D1RN0.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataatttgttcgtgtataaacagaagtcaggccagtcgcctgtgttggtcatctatacaaaatattaagcggcctcgacggggtcctgagcgaatcgcgtggcgcaagtcgtgggaccacgaggcacgctacgaccatcagtgtacgacccgaggctggtggagtggaggcagtactattacgtgtcgagggcgtagggacgtagtagcgtcgtgtgtagttttcgggcggtacgggaccgagtcgtacgtaccgtccgtaggtcgacgacccgaggccgtccgcccccgtcccgg

SEQ ID NO: 148083 - DNA, 571 bp, Homo sapiens
  misc_feature: GYAE6OF01CJCAD.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaaccattacatgctcgtggaagaagcgttgagacgtattaaatttgtttcgtaggtaataaacagaagtcaggcagtcgctgtgttgtcatctatactaaaatattaagcgcctcgacgggtccctgacgcgaatctcgtgcgacaagtcgtacgggaccacgacggccacgctacgacctatcgagtcgtacgacccgaggtctggtggtagtggacggctagtacttagtactagtcgtagggacgtagggacgtaggtacgcgtcgtggtagtacgttttccgggacgggtacgggaccgtacggtcgtacggtaccgttccggtaaggtccgacggacccgaacgggcccttccggcccccgttaccgg

SEQ ID NO: 148084 - DNA, 509 bp, Homo sapiens
  misc_feature: GYAE6OF01BN44D.10.4.A04.1.454.CMB.1.raw
  modified_base (170)..(170): a, c, t, g, unknown or other
  misc_feature (170)..(170): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccagaggcacgctgaccatcagtgtgacccgaggctgtggatggaggcagactattactgtcaggtcggtgggacgagtagcgtcgtgtgtagttttcgggcggagggaccgaagctggaccgtccgtaggtcgacgacccgaaggcctcggcccccgtccgg

SEQ ID NO: 148085 - DNA, 522 bp, Homo sapiens
  misc_feature: GYAE6OF01C8LZ2.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgttcgtggtaataaacagaagtcaggccagtcgctgtgttggtcatctatacaaaatattaagcgcctcgagggtccctgagcgaatctcgtggcgccaagtctagggaccacgaggcacgctgaccatcagtgtcgacccaggctgtgatggaggcagactatactgtcgaggcgtgggacgtaggtagcgtcgtgtgtagtttcgggcggtagggaccgaaggtcgtacggacccgtccgtacggtaccgacggacccgaaggccgtccggcccccgtccggg

SEQ ID NO: 148086 - DNA, 514 bp, Homo sapiens
  misc_feature: GYAE6OF01BX4YY.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaattgtttcgtggtataaacagaagtcaggccagtcgcctgtgttggtcatctatcaaaatattaagcggccctcgaggggtccctgagcgaatctctggcgccaagtctgggaccacaggcacgctgaccatcagtgtcgacccaggctgtggagtgaggcagactattactgtcgaggcgtgggacagtagcgcgtgtgtagtttcggcgggtagggaccgaaggtcgtcggacccgtccgtaggtccgtacggccccaaggcctcggcccccgtccggg

SEQ ID NO: 148087 - DNA, 507 bp, Homo sapiens
  misc_feature: GYAE6OF01BG3A7.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctggggaccacaggcacgctgaccatcagtgtgacccaggctggtggatgaggcagactattactgtcgagggcgtgggactaggtagcgcgtgtgtagttttcgggcgggagggaccaaggctcggacccgtcgtaggtcacgcccaaggcctcgcccccgtccgg

SEQ ID NO: 148088 - DNA, 526 bp, Homo sapiens
  misc_feature: GYAE6OF01BTT89.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctcgtggagaagcgttgagcgattaaatttgtttcgtggtaataaacagaagtcaggccagtcgcctgtgttggtcatctatacaaaatattaagcggccctcgacggggtccctgagcgaatctcgtggcgccaagtcgtgggaccacgaggcacgctcgaccatcagtgtcgacccaggctgtggatggaggcagactattactgtcgaggcggtgggacgtagtagcgtcgtgtgtagtttcggcggagggaccgaagctacggacccgtccgtacggtccgacggacccgaaggcctccggcccccgttccgg

SEQ ID NO: 148089 - DNA, 524 bp, Homo sapiens
  misc_feature: GYAE6OF01CKQS3.10.4.A04.1.454.CMB.1.raw
  modified_base (170)..(170): a, c, t, g, unknown or other
  misc_feature (170)..(170): n is a, c, g, or t
  modified_base (338)..(338): a, c, t, g, unknown or other
  misc_feature (338)..(338): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagaagcgttgagcgataaatttgtttcgtaggtaataaacagaagtcaggccagtcgcctgtgttggcatctatacaaaatattaagcggcctcgaggggtccctgacgcgaatctcgtggcnccgaagtcgtaggggaccacaggcacgctcgaccatcagtgtcgacccgaggctggtgagtggaggcagactatacgtgtcgaggcgtagggacgagtagcgtcgtgtgtagtttcgggcggtaggaccgaaggactcggaccgtcctacgggtcacggcccaaggtcctccggtccccgtaccgg

SEQ ID NO: 148090 - DNA, 545 bp, Homo sapiens
  misc_feature: GYAE6OF01AIFUW.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgattaaattgtttcgtaggtataaacagaagtcaggccagtcgcctgtgttggcatctatacaaaatattaagccggccctcgacggggtccctggacgcgaatctcgtggccgccaagtcgtcggggaccacgacggcacgctcgaccatcagtgtcgacccaggctgtggagtgaggcagactattactgtcgagggtcgtagggacgtagtacgcgctggtgtacggtttcgggcgggtaacgggaccgaggtcgtacggacccgttccgtagggtccgacggaccccgaaggcctccggtcccccgtaccggg

SEQ ID NO: 148091 - DNA, 548 bp, Homo sapiens
  misc_feature: GYAE6OF01BW7VN.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtcgccaggagagacagccaccattacatgctctggagaagcgttgagcgaattaaatttgtttcgtggtaataaacagaagtcaggccagtcgcctgtgttggtcatctatacaaaatattaagcggccctcgacggggtccctgagcgaatctcgtggcgccaagtcgtcgggaccacgaggcacgctgaccatcagtgtcgacccaggctggtggatggaggcagactaattactgtcgaggcggtagggactaggtaggcgcgtggtgtacgttttcgggacgggtacgggaccgaaggtctacggacccgttccgtaaggtccgtacggaccccgaagggccctccggtccccccgtaccggg

SEQ ID NO: 148092 - DNA, 505 bp, Homo sapiens
  misc_feature: GYAE6OF01COI52.10.4.A04.1.454.CMB.1.raw
  modified_base (170)..(170): a, c, t, g, unknown or other
  misc_feature (170)..(170): n is a, c, g, or t
  modified_base (311)..(311): a, c, t, g, unknown or other
  misc_feature (311)..(311): n is a, c, g, or t
  modified_base (337)..(337): a, c, t, g, unknown or other
  misc_feature (337)..(337): n is a, c, g, or t
  modified_base (459)..(459): a, c, t, g, unknown or other
  misc_feature (459)..(459): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccagggagagacagccaaccattacatgctctggagaagcgttgagcgataaatttgtttcgtggtaataaacagaagtcaggccagtcgcctgtgttggtcatctatcaaaatattaagcggccctnaggggtccctgagcgaatctctggcncaagtctgggaccacaggcacgctgaccatcagtgtgacccaggctgtggatgagcagactattactgtcgaggcgtgggacaggtagcgtcgtgtgtagtttcgggcggtagggaccaagntcgaccgtccgtaggtccgacgacccgaaggccgtgccccctccgg

SEQ ID NO: 148093 - DNA, 517 bp, Homo sapiens
  misc_feature: GYAE6OF01B4WF5.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatacaaaatattaagcgccctcgaggggtccctgacgcgaatctcgtggcgccaagtctgggaccacgaggcacgctgaccatcagtgtgacccaggctgtggatgaggcagactattactgtcgaggcggtgggacgtaggtacgcgcgtggtgtagtttcgggcgggagggaccgaagctcggcccgtccgtacggtcgacggacccgaaggccgtccgccccgtccgg

SEQ ID NO: 148094 - DNA, 563 bp, Homo sapiens
  misc_feature: GYAE6OF01DXDJY.10.4.A04.1.454.CMB.1.raw
  modified_base (127)..(127): a, c, t, g, unknown or other
  misc_feature (127)..(127): n is a, c, g, or t
  modified_base (322)..(322): a, c, t, g, unknown or other
  misc_feature (322)..(322): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttacngcacagcatccgtggcctcctctgacctgactcagcccaccctcactgtccgtgtcgccaggagagacagcccacattacatgctcgtggagagcgttgagcgtaattaaatttgtttacgtaggtaataaacgagaagtcaggccagtcgctgtgtgtcatctatacaaatattaagcgtcctagacgggtccngacgcgaatcgtctcggaccaccgtaaggtcgtacgggaccacgacggcacgctacgaccagtacgagtcgtacgacccgaggcgtggtacggagtaggacggcaagtacttagttacgtgtacgagggtcgtacgggacgtaggtacgcgtgtgtagttcggttcgggacggaaggaccgacgtcggtacgtcccggtacgtacggcgtacgacccgtacggccgtcccgcccgtaccgg

SEQ ID NO: 148095 - DNA, 616 bp, Homo sapiens
  misc_feature: GYAE6OF01AFT7C.10.4.A04.1.454.CMB.1.raw
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (363)..(363): a, c, t, g, unknown or other
  misc_feature (363)..(363): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtcccgtgtccgccagggagagacagcccacattacatgctcgtggagaagcgttgagacgtaattaaagttttgtttcggtaggtaataaacaggaagtcgaggccaggtcgccttgtgttggcatctatacaaattntaagcgcctgacgggtccngagcgatctgtgcgacagtcgtaggaccacgnggcacgcacgacatcgagtcgtcgaccccgaggcgtggtaggagtacggacggtacgagtacttacgttacgtcggtacgtacgggtcggtaggggactaagggttacgcggttctagggttacggtacggttttcggggaccgggtaacgggtacccgtaggtaccggttacggtaccccggttccgttaacgggtaccgtaaccgggtaccccgtaaagggccccggtttaccgccccccgggttaccggg

SEQ ID NO: 148096 - DNA, 655 bp, Homo sapiens
  misc_feature: GYAE6OF01BDC6J.10.4.A04.1.454.CMB.1.raw
  modified_base (231)..(231): a, c, t, g, unknown or other
  misc_feature (231)..(231): n is a, c, g, or t
tcagcatagtagtgcacgaccggtgctcgatttagagtagtgatcagggggctgggcctcaggaagcagcatcgggaggtgcctcagccatggcatggatccctctcttcctcggcgtccttgcttactgcacagcatccggtggcctcctctgacctgactcacgcccaccctcacttgtccgtgtccgccaggagacgacagcccacctattacatcgctcgtgggaanaaggtcgttggacgtacgtaatttaaagttttggtttacgtaggttaataaacgaaggtaacgtcgaggccgtacggtccgtccgttggtggttcggtactattactaataactaaaattacttaacggccggtcctacggtaacggggtccctaggacgacgtaactcgtcgtcggcgaccgtaacgtcgtacgggaccacgacggcacgctacgactatcgtacggtcgtacgacccgaggtcgtggtaggagtggacggacgtaacgtacttattacgtgtacgacggtcggtaggacgtacggtacggtcgtacgttggtacggttacggtttcggggacggacgggaccgtacggtcgtacggtaccggtccgtacggtaccgacggacccgtacggccgtacccggtcccgttaccgg

SEQ ID NO: 148097 - DNA, 802 bp, Homo sapiens
  misc_feature: GYAE6OF01CVUL5.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtcctgcttactgcacagcatcccgtggcctcctctgacctgactcagccaccctcactgtccgtgtcgccaggagagacagccaaccattacatgctcgtaggagaagcgttgagacgtaattaatttgtttacgtaggttaataaacagaagtcgaggccagtccgcctggtgttggtcattctaatactaaaaattattaaacgcccggtccctacgacgggggtccctggacgcgtaactcgtcgtggccgaccgtaacgtcgtacggggacccacgacgggcctacgctacgaacctataccgtaaggttcggtaccgaaccccgtagggtccgttagggtacggagttacggaacgggtaccgtaacgtaaccgtttaacgttaaccggttacgggttacccggtaacggggtaccggggttacggggtaaaccgtacggggtaacggtcgggttaccgtttagggttaacggggtttacgggtttttaccccggggggacgggggttaaacccgggggtaaacccgggtaaacggggttacccggttaaccggggttaaacccccccgggtttacccgggttaaacgggggttaacccccggtaaacccgggtaaccccccggtaaacccgggggttcccccggttcccccgggtccccccccccgggtttaccccggggg

SEQ ID NO: 148098 - DNA, 513 bp, Homo sapiens
  misc_feature: GYAE6OF01D0K3P.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtcccgtgtcgccaggagagacagccaccattacatgctctggagaagcgttgagcgataaatttgtttcgtggtataaacagaagtcaggccagtcgctgtgttggtcatctatacaaaatattaagcggcctcgacggggtccctgagcgaatctctggcgccaagtctgggaccacaggcacgctgaccatcagtgtcgacccaggctgtggatgaggcagactattactgtcgaggcgtgggacaggtacgcgtcgtgtgtagtttcgggcggtagggaccgaagcgtacggacccgtccgtaggccgacgacccgaaggcctcgcccccgtccgg

SEQ ID NO: 148099 - DNA, 789 bp, Homo sapiens
  misc_feature: GYAE6OF01ETN3J.10.4.A04.1.454.CMB.1.raw
  modified_base (171)..(171): a, c, t, g, unknown or other
  misc_feature (171)..(171): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtgcctcctctgacctgactcacgcccaccctnactgtccgtgtccgcaggagagacagccaacattacatgctcgtggagagtcgttgagtacgtaattaaatttgttcgtaggtaataaacgagaagtcaggccagtcgtcctgtgttggtctatctatactaaaatattaacggccgtcccgtacgacggggtccctaggacgacgtaactctcgtacggccgtaccgtaaaggtccggtacgggacccaacgacggtccaaccggtctaccgaacctacgtacgtacggtcggtacggaaccccgtaacgggtccgttagggtacgggtaacgttacgggacggtaaccgtaacggttaaccgtttaacgtttaaccgttcgggtaacggtaacggggtacgggtaacggggtaacggtaacgggttaacgggtccggttaccggttacgggtttacggttaacgggtttttaccgggggaaccgggggtaaaccggggtaaacccggtaacgggttacccggttaacccggggttaacccccgggtttacccgggtaaaccggggttacccggtaaaccccgggtaaccccggtaaacccggggttccccggttcccccgggtacccccccgggtttaccccgggg

SEQ ID NO: 148100 - DNA, 592 bp, Homo sapiens
  misc_feature: GYAE6OF01EWPZC.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtgcctcctctgacctgactcagccaccctcactgtccgtgtccgccaggagagacagccaccattacatgctcgtggagaagcgttgagcgaattaaatttgtttcgtaggtaataaacagaagtcaggccagtcgctgtgttggtcatctatacaaatattaagcggcctcgacggggtccctgagcgaatctctggcgaccaaggtcgtcgggacccacgaggcacgctacgaccatcagtgtacgacccgaggcgtggtcggagtggacggcgagtactagttacgtgtcgagggtcggtgggaacgtaggtacggacgtcgttggttaggttacggttttcgggaccgggtaacgggaaccgaaggtaccgtacggtaacccggttccggttaacggtaccgaccggtacccgaaacgggtcccgttacccgtcccccggttacccggg

SEQ ID NO: 148101 - DNA, 639 bp, Homo sapiens
  misc_feature: GYAE6OF01B77DW.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccggtggcctcctctcgacctgactcagccaccctcactgtccgtgtccgccaggagagacagccaccattacatgctcgtaggagagcgttgagtcgtaattaaagtttgtttacgtaggtaataaacagaagtcaggccagtcgctgtgttggtcatctatacaaatataagccggcctcgacgggtccctggacgcgaatcgtcgtcggccgaccgaagtcgtacgggaccacgacggcacgctacgacatacgagtcgtacgacccgaggtctggtcggagtggaggacacgtacttagttactggtacgagggtcggtagggacgtaggttacggcgtcgttaggttacggttacggttttaccggggaccggggtaacggggtaacccgtaacgggtacccggttaccgggtaacccggttacccgggttaacggtacccggtaaccgggtaccccggtaacgggtcccgttccccggtccccccggttaccccggg

SEQ ID NO: 148102 - DNA, 513 bp, Homo sapiens
  misc_feature: GYAE6OF01A2JTQ.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgattaaatttgtttcgtggtaataaacagaagtcaggccagtcgcctgtgttggtcatctatactaaaatattaagcggccctcgacggggtccctgagcgaatcgtctggccgccaagtcgtagggaccacgaggcacgctacgaccatcagtcgtcgacccgaggctggtgagtgaggcagactattactgtcgaggcgtggactagtagcgtctgtgtgtttcggcggaggaccgacgcgtcgcgtccgtaggcgacgacccgaggcctccgccccgtccgg

SEQ ID NO: 148103 - DNA, 532 bp, Homo sapiens
  misc_feature: GYAE6OF01CHDD4.10.4.A04.1.454.CMB.1.raw
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacngccaccattacatgctctggagaagcgttgagcgataaatttgtttacgtaggtaataaacgagaagtcaggccagtcgcctgtgttggtcatctatacaaaatattaagcggaccctgagggtccctgagcgaatcgtacgtggcgccgaagtcgtcgggaccacgaggcacgctcgaccatcagtgtcgacccgaggcgtgtggagtggaggcagtactattactgtcgaggcggtgggacgtaggtacgcgtcgtggtgtacgtttcgggcgggagggaccgtagcgtcggccgtccgtagtcgacgacccgaacggctccgtccccgtcccgg

SEQ ID NO: 148104 - DNA, 549 bp, Homo sapiens
  misc_feature: GYAE6OF01C9M0S.10.4.A04.1.454.CMB.1.raw
  modified_base (448)..(448): a, c, t, g, unknown or other
  misc_feature (448)..(448): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgaataaatttgtttcgtaggtaataaacagaagtcgaggcagtcgctgtgttggtcatctatcaaaatattaagccgccctcgaggggtccctagacgcgaaatctactggcgccgaaagtcgtcgggaccacgaggcaacgctgaaccatcagtgcgacccaggctggtggatggaggcagtacttattactgtcgaaggcgtagggactaggtagcgngttggtgtagtttcgggacgggtacgggaaccgaacggtcgtacggtacccgttccgtaggtccgaacgacccgaagggccctccggcccccgttaccggg

SEQ ID NO: 148105 - DNA, 526 bp, Homo sapiens
  misc_feature: GYAE6OF01A4OGM.10.4.A04.1.454.CMB.1.raw
  modified_base (170)..(170): a, c, t, g, unknown or other
  misc_feature (170)..(170): n is a, c, g, or t
  modified_base (343)..(343): a, c, t, g, unknown or other
  misc_feature (343)..(343): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagaagcgttgagcgataaatttgtttcgtggtataaacagaagtcaggccagtcgcctgtgttggtcatctatacaaaatataagcgccctgaggggtccctgagcgaatctcgtggcgccaagtcgngggaccagaggcacgctgaccatcagtgtcgacccgaggctggtggagtggaggcgagactattacgtgtcgaggcggtagggacgtagtagcgcgtgtgtagtttcggcggtaacgggacgaggtcgtacggacccggtcgtacggtacgacggacccgaaggcctccggccccgttccggg

SEQ ID NO: 148106 - DNA, 774 bp, Homo sapiens
  misc_feature: GYAE6OF01EGFOY.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtgcctcctctgacctgactcagcccaccctcactgtccgtgtcgccaggagagacagccacattacatgctctggagaagcgttagagcgaattaaatttgtttcgtaggtaataaacagaagtcaggccagtcgctgtgttgtcatctatacaaaatattaagcgcctcgacgggtcctagacgcgaatctcgtggccgtaccgaaaggttccgtacggggaacccaacggacgggaccaaccggtacttacggaaccctaacgttaccgtaaggttacgggtaccggaacccccgtaagggtcccgttagggtacgggtaacgttagggaacgggaccgtaaggtaaccgttttaaacgttaaccgttcgggtaaccgtaaggggtaccgggttaacgggggaaacgtaacggggttacgggtcccggttacggtttacgggttacgggtttaacggttttaccgggggaccggggggtaaaccggggtaaaccccggtaaacggggttccccggtttaaccggggaacccccggtttacccggtttaaacggggtaccccggtaaaccgggaaccccccggtaaaacgggttccccggtttccccgggacccccccccgtttaacccggggg

SEQ ID NO: 148107 - DNA, 564 bp, Homo sapiens
  misc_feature: GYAE6OF01D8N80.10.4.A04.1.454.CMB.1.raw
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (409)..(409): a, c, t, g, unknown or other
  misc_feature (409)..(409): n is a, c, g, or t
tcagcatagtagtgcacgaccggtgctcgatttagagtagtgatcagggggctgggcctcaggaagcagcatcggaggtgcctcagccatggcatggatccctctcttcctcggcgtccttgcttactgcacagcatccgtggcctcctctgacctgactcagccaccctcactgtccgtgtcgccgaggagagacagccaccattacatgctctggagaagcgttgagcgaattaaagtttgtttcgtggtaataaacagaaagtcaaggcagtcgcctgtgttggtcatctatacaaaatnttaagcgtcctcgaggggtccctgagcgaatctntggcncaagtctagggaccagagcaacgctgaaccgatccgaagtgtacgacccaggctggtggatggacgngagtactattactagtcgacgggcggtagggaacgtaggtacggacgtcgttggtcggtaagttttcgggacgggtacgggaaccgtaaacgtcgtaccggtaccggtaccgtaggtaccgacgaccccgaaggtccgtcccgccccgtacccgg

SEQ ID NO: 148108 - DNA, 649 bp, Homo sapiens
  misc_feature: GYAE6OF01A03JI.10.4.A04.1.454.CMB.1.raw
  modified_base (429)..(429): a, c, t, g, unknown or other
  misc_feature (429)..(429): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtcccgtgtccgccagggagacgacacgcccaacctattacatgcctcgtaggagaagtcgttgagtacgtaattaaagtttggtttcgtaggtaataaacgagaagtcgaggacctaggtccgtcctggtgttggtcatctatacaaatactaagccgccgtcgacgggtcccagacgacgtatctgtcggccgaccgtaagtcgtacgggaccacgacggccacgcgtacgacctagtcagtcgacgacccgnggtacgtggagagtggacgcgagtactagttacgtgtacggacggtcggtacgggacgtaggtacggcggtacgttggttacgggttacgtttaccgggggacggtaaccggggtaccgtaaacgggtcccggtaccggtaccccggttaccgtaacgggtacccgtaaccggtacccccggtaaacggtcccccgttacccgtccccccggttacccgg

SEQ ID NO: 148109 - DNA, 733 bp, Homo sapiens
  misc_feature: GYAE6OF01C4AUF.10.4.A04.1.454.CMB.1.raw
  modified_base (104)..(104): a, c, t, g, unknown or other
  misc_feature (104)..(104): n is a, c, g, or t
  modified_base (172)..(172): a, c, t, g, unknown or other
  misc_feature (172)..(172): n is a, c, g, or t
tcagcatagtagtgcacgaccggtgctcgatttagagtagtgatcgaggggctgggcctcaggaagcagcatcggaggtgcctcagccatggcatggatccctntcttcctcggcgtccttgcttactgcacagcatccgtgcctcctctgacctgactcacgcccaccctnactgtccgtgtcgccgagggagagacagccaactattacgatgcctgtggagaagtcgttagagcgtaattaaagtttgtttcggtaggtaataaacgagtaagtcgacggccagtcgcctggttgttggtctatcctaagtaactaaaaattagttaaacggccggtaccccgtacggaacgggggtccctaggacggacggtaaactcgtacgtacgggaccgaccgtaaaggtccgtacggggaacccacggaacggccaacggtccgtacggaacctacgtacgtacggttcggtaccggaacccgtagggtccgttaggtacgggagttacgggaacggaccgtaacggtaacttaacgtttacgtacggtacggtaacgggtcgggtagggaaccgtacgggtacggtccggtacgttaggtacggttacggttttccggggacggggtaacggggaaaccggaacggtaccggtacggtacccggttaccgttaacgggtaccgtaacccggacccgtaacgggtccccgtcccggtccccccggttacccggg

SEQ ID NO: 148110 - DNA, 206 bp, Homo sapiens
  misc_feature: GYAE6OF01CHEDW.10.4.A04.1.454.CMB.1.raw
  modified_base (192)..(192): a, c, t, g, unknown or other
  misc_feature (192)..(192): n is a, c, g, or t
  modified_base (205)..(206): a, c, t, g, unknown or other
  misc_feature (205)..(206): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggaganacagccacatacnn

SEQ ID NO: 148111 - DNA, 811 bp, Homo sapiens
  misc_feature: GYAE6OF01AQWI6.10.4.A04.1.454.CMB.1.raw
  modified_base (172)..(172): a, c, t, g, unknown or other
  misc_feature (172)..(172): n is a, c, g, or t
  modified_base (195)..(195): a, c, t, g, unknown or other
  misc_feature (195)..(195): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcacgcccaccctnacttcgtccgtgccgccgagganagaccacgccactattacatcgctcgtaggaagagtcgttagacgtacgtaatttaaagttttggtttacggtaggtaaactaaaacgtagtaacggtccgtaacggcctaacggttccgtcggtttgggttacggtttcggtaacctaatttaccgtaaattaaaaccgtaaaagtttaacgttaccgggtaccccggtaccccgttacggggtaacccggggtttccccaggtaaccggtaaccgttaaacttccgtaccgggtcgggacccgtaaccgtaaacgggttccggtaccggggaacccaacggacggtaccctaacggcgttaaccgtaacctaacgttccgtaacgggtcgtaaccgggaaccccgtaacgggttacgttagggtacgggtaacgtacggggaacggtaccgtaaacggtaacgtttaacgttaccggtacgggtacgtacggggtacgggtaacggacgtaacggtacggtcgttacggtacggttacggttccgggtttaccgggaccgggtaaacggtaccggtacgtaccgtacggtacccggtacgtacggccgaccgtaccggaccggtccctccccggcccgttaccg

SEQ ID NO: 148112 - DNA, 718 bp, Homo sapiens
  misc_feature: GYAE6OF01DX7UG.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcacgcccaccctcactgtcccgtgtcgccagggagacgacagccaaccattacatgctcgtggagaagtcgttgagacgtaattaaagttttgtttacggtaggtaactaaaacgaagaagtcgacggaccagtccggtccttggttgttcggtctagttactaatactaaaagttattaaacggccggtaccctcgacggggtccctggacgcgtaactcgtcgtcggaccgaccgtaaaggtccgtacgggaccaacgacggaccacgtcgtacgaacctacgtcaacggtcgtaccggaccccggtaggccgttagggtcggtagtagggacggacgtaacggtacctttaacgttaccgtcggtacggtacggggtaccgggtacggggaacgtaggtacggtccggtacgttcggttaggttaaccgggttttaccgggaccggggtaaccgggtacccgtaaaccggtcgttaccgggtaacccggttccggttaacgggtccctaacgggaccccgtaacgggtcccctacccggtcccccggttaacccgg

SEQ ID NO: 148113 - DNA, 568 bp, Homo sapiens
  misc_feature: GYAE6OF01DKET7.10.4.A04.1.454.CMB.1.raw
  modified_base (451)..(451): a, c, t, g, unknown or other
  misc_feature (451)..(451): n is a, c, g, or t
tcagcatagtagtgcacgaccggtgctcgatttagagtagtgatcagggggctgggcctcaggaagcagcatcggaggtgcctcagccatggcatggatccctctcttcctcggcgtccttgcttactgcacagcatccgtggcctcctctgacctgactcagccaccctcactgtccgtgtcgccagggagagacagcccaaccattacatgcctctggagaagcgttgagcgaattaatttgtttcgtaggtaataaacagaagtcgaggccagtcgcctggtcgttggtcatctatacaaaatattaagcggcctcgacgggtccctgagcgaatctcgtcggcgaccgtaagtcgtcgggaccacgacggcacgcgtacgaccatcgagtcgtacgacccgaggcgtggtggatggaggacgagtacttattacgtcgtcgacgggnggtacgggactaggtagcgttcgtggttaggtacggtttcgggacgggtacgggaccgaacggtcgtacggtaccgtccgtaggccgacggaccaaggcctccgtccccgttaccgg

SEQ ID NO: 148114 - DNA, 908 bp, Homo sapiens
  misc_feature: GYAE6OF01AEUUR.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcacgtgtcccgtgtccgccgagggacgagaccagcccaacctatttaccatcggcccttgtagggaacgtaacgccgggttttaggaacgtccggtaaatttaaaaggtttttcggtttttaccgggttaagggttaaactttaaaaaccgaaggtaaaggttcccgaacggggtaccctaacgggtccggtcccgtttaggttcgggttttacgggttcccaagtttaccgttaacgttaacctaaaaaaagttttacgtttaaaaccgggcccgggttacccccgttacggttaaccggggggttaccccctttagggaaccggtaaccggttaaacgttcccgtttaccggtaccggggtaccggaaccccgttaaacgggtttccggttaccggggtaaaaccccaaccggacggggacctaccggccgttaacggaccctagtaaccggtacggtacggtaccgtaacccggacggttccgtagggtacggtagtacggaacggacgtaacgtaaccgtttacgttacgtcggttacggacggttaccggtagggaacgtacgggttacgcggttacgtagttagggttacgtttaccggggacgggtaaaccgggtacgtaaccgggtaccgttacgggtaacccgggttaccgttaacggggtccccgtaaaccgggaccccgggttaaaccggtccccgggttaccccccggtccccggtttacccccgg

SEQ ID NO: 148115 - DNA, 655 bp, Homo sapiens
  misc_feature: GYAE6OF01CZWJF.10.4.A04.1.454.CMB.1.raw
  modified_base (220)..(220): a, c, t, g, unknown or other
  misc_feature (220)..(220): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatcccgtggcctcctctgacctgacctcagcccaccctcacttggtcccgtgtccgccgagggagagacacgcccaacctattacntcgctcgtaggagagtcgttgagtcgtaattaaagttttgtttacggtaggttaataaaacgtaagaacgtcgaggccacggtccgccgtgttggttggtctatctataactaaaatagttaacgccggaccctacggaccggggtccctaggacgacgtaactcgtcgtcgggaccaccgtacgtccggtacgggacccacgacggcgaccgcctacgaccctactacacggtcgtaccggacccgtaggcgttagggtaggtagtacgggtaacggacgtacgtacgtttaacgttacgttgggtacgacgggtacggtacgggacgtacggtacggcgttacgttggttaggttacggtttcgggacggtacggacgacgtcgttaccgccggtcgtacggcgaccggaccgacgccgtcccgtccccgtcg

SEQ ID NO: 148116 - DNA, 578 bp, Homo sapiens
  misc_feature: GYAE6OF01BQXFM.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagtcgttgagcgaattaaatttgtttcgtaggtaataaaacgagaagtcaggccaggtcgcctgtgttggtcatctatacaaaattgtaagcgccctgagggtccctgacgcgaatctcgtcggcgacgaagtcgtacgggaccacgaggccacgctacgaccatacagtgtcgacccgaggctcggtggagtggacggacgaacgtacttacgttacgtgttacgagggtccggtagggacctaggtacgtcgacgtggtgttacgtttcgggcggtaacgggacccgaaggtcgtacggtacccggttacgtacggtacgaccggacccgaagggtccctcccggtccccgttaccgg

SEQ ID NO: 148117 - DNA, 809 bp, Homo sapiens
  misc_feature: GYAE6OF01ALE6R.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcacgcccaccctcacttgtccgtgtccgccgagggagagaccacgcccaccatttacatgcctcgtagggaagaagtcgttgacgtacgtaattaaagtttggtttcgtaggtaactaaacgagtaacgtcgacggccgtacggtccgtccttgggttcggttggtactacgtttaccttaacgttaactaaaaagtttacgtttaaaccgggcccggtccccgttacggtaaccgggggttccctaaggacggtaccgtaacgttcccgttcggtcgggaccgtacccgtaacgggttccgtacggggaacccaacggtacgggacccaccggtccgtacggtaaccgtacgttccgtacgggttaccggtaccggtaaccccggtacgggtcgttacggggttacgggtaacggtacggtaacgggtaccgtaagttaacccgttaacgtttacggtaccggttacgggtaaccgggtcgggtaacgggaccgtacgggttaccggcggttacgttacgggttacggttacggtttcggggaccgggtaccgggtaaccgtacggtaccgtaccgggttcccggttaccggtaccggtccgtacccggtcccgtaaccggtcccgtacccggtcccccggttaccggg

SEQ ID NO: 148118 - DNA, 625 bp, Homo sapiens
  misc_feature: GYAE6OF01B1IWN.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccggtgcctcctctgacctgactcacgcccaccctcacttgtccgtgtccgccaggagagacagcccaaccatttacatcgccttcgtagggagtaaggtcgttagaggtacgtaattaaattttgtttcggtagtaactaaacgagtaagtcgaggcctagtccgcctgtggttggtcatctagtactaaaagtattaacggccgtcccgtacgacggggtacccctggaacgacgtaactcgtcgtcggaccgtaccgaacggtcgtacgggacccaacgacggaccacggtcgagacccagtccgtagtcggtacgacccgaggtcgtaggtggtagaggacggtacgagtacttagttacgtgtcggaggcggttaggacgtaggactcggcgtagtgttaggtttccgggcggaacggtaccgagtccgtagtcccgtacgttaacgcgtacgacccgaagtccgtacccggtccccgtaccgg

SEQ ID NO: 148119 - DNA, 694 bp, Homo sapiens
  misc_feature: GYAE6OF01BTKFY.10.4.A04.1.454.CMB.1.raw
  modified_base (171)..(171): a, c, t, g, unknown or other
  misc_feature (171)..(171): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctnactgtccgtgtccgccaggagagacagccaccattacatcgactcgtggaagtagcgttaggagtacgtaattaaagtttgtttacggtaggtaactaaacgaggaagtcgaggccaggtccgcctggttggttcggtcactctaataactaaaattacttaacggcggtcccgttacggaccggggtccctggacgacgtaattccgtcgtcggccgaccgaggtcgtacgggaccacgacggccgaccgcgtacgacctacgtacgtagtcgtaccgaccgtaggtcgtggtgagtcggaggtacagtacttagttaccgtgtcggacgggtcggtagggaacgtacgggtacggtcgtggttacggttaggttacgggttttaccggggaccggggtaaacggggtaaccggaacgggttaccgttaccggggtaccccggttaccgggttacgggtaacccggtaccggtaaccccgggtaaccggtcccggtaacccggttccccccgggttaccggg

SEQ ID NO: 148120 - DNA, 726 bp, Homo sapiens
  misc_feature: GYAE6OF01CBB63.10.4.A04.1.454.CMB.1.raw
  modified_base (112)..(112): a, c, t, g, unknown or other
  misc_feature (112)..(112): n is a, c, g, or t
  modified_base (129)..(129): a, c, t, g, unknown or other
  misc_feature (129)..(129): n is a, c, g, or t
  modified_base (177)..(177): a, c, t, g, unknown or other
  misc_feature (177)..(177): n is a, c, g, or t
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (336)..(336): a, c, t, g, unknown or other
  misc_feature (336)..(336): n is a, c, g, or t
tcagcatagtagtgcacgaccggtgctcgatttagagtagtgatcgaggggctgggcctcaggaagcagcatcggaggtgcctcagccatggcatggactccctctcttccncggcgtccttgcttacngcacagcatccgtgccctcctctacgacctgacctcacgcccaccctnactgccgtncgccaaggaganacncgaccactattacagtgcctcgaggaagtacggtcgttagagtacgtaatttaaagtttcggttacgtaggtaaactaaacgtaggaagtccgaggcccgtagtccgtcttcggttgtcggtactagttactaanaactaaatacgtacggacccggcctacggacgggtaccctaggacgacgtaactcgttacgcgggacccgtacgtaacgttccggaaccgggtacaaccggtcggaaccaccggtacgtaccgacgtaactcgtaacgtcggtaccgacccgtaggtacgtcggtaggtacgagggtacgacgtacgtaacgttaacgtaggtaccggtacgtacgggtcggtaacgggacgtaacggtacgcggttaccggtggttacggttaccggtttacgggtacggggaaccggtaaccgtacgggttacccggtaacccggttacggtacccggtaacggaccgtacccggaccggtaaaccggtccccggacccggtacccccggttccccgg

SEQ ID NO: 148121 - DNA, 747 bp, Homo sapiens
  misc_feature: GYAE6OF01BC5HE.10.4.A04.1.454.CMB.1.raw
tcagcatagtagtgcacgaccggtgctcgatttagagtagtgatcgaggggctgggcctcaggaagcagcatcggaggtgcctcagccatggcatggatccctctcttcctcggcgtccttgcttactgcacagcatccgtgccctcctctgacctgactcacgcccaccctcactcgtccgtgtcgccgaggagacgacacgcccaacctattacatcgctcgtggaagaggtcgttgacgtacgtaattaagtttggtttacgtaggtaataaacgaggtaacgtcgacggcctaggtccgccgttggtcggtttcggtactacgttcttaacttaacgtaaaactttaacgtaacggcccgggtaccccgttacggtacggggttacccctaggacggtacgtaacttccgtacggtcggaccgtacgtaacggttccgtacgggaccctacggacggaccaccggtacgtacgaaccctagtacgtacggtacggtaccgtaaccccgtagggtcgttaggtacgggacgtggaaccgggactaacggtaacgtttacgtttacgtacggtacggtaacggggtccgggttacgggaacgtacgggtacgtcggttacggttacggtacgttaccgggttaccggggacggggtaacggtaaccgtacggtcctaaccgggtcccgttcggttacggaccgtaccggacccggaaggtcccgtcccccggtccccgtaccggg

SEQ ID NO: 148122 - DNA, 560 bp, Homo sapiens
  misc_feature: GYAE6OF01D59SW.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtcgccaggagagacagccaccattacatgctctggagaagcgttgagcgattaaatttgtttcgtggtataaacagaagtcaggcagtcgcctgtgttggtcatctatacaaaatattaagcgccctcgacggggtccctgacgcgaatctacgtggcgcctaagtcgtcgggaccacgaggcacgctgaccatcagtgtcgacccaggctgtggatggaggcagtaacttattacgtgtcgaggcggtagggactaggtacggcgtcgttggtagttacggttttcgggacgggaacgggaccgaaacggtccgtacggacccgttaccgtaggtaccgacggaccccgaaggcccgttcccggcccccgttaccggg

SEQ ID NO: 148123 - DNA, 877 bp, Homo sapiens
  misc_feature: GYAE6OF01EKUOB.10.4.A04.1.454.CMB.1.raw
  modified_base (514)..(514): a, c, t, g, unknown or other
  misc_feature (514)..(514): n is a, c, g, or t
tcagcatagtagtgcacgaccggtgctcgatttagagtagtgatcagggggctgggcctcaggaagcagcatcggaggtgcctcagccatggcatggatccctctcttcctcggcgtccttgcttactgcacagcatccgtgcctctctcgacctgactcacgcccacccttcactcggtcccgtgtccgccgaagggacgagaccgacgccccaacctatttaccagttcggaccttcgtaggaacggaacgtcgttagacgtacgtaatttaaagttttgtttcggtaggtaataaacgaggtaagtacgacggtccaaggtccgtccgttggtttggtttcggtactaacttcgttaactaaccgtaaaaagtttacgtttaacggcccgggttacccctacgggtaacgggggttccctaggaccggtaccgtaacttccgtcggtacgggaccaaccggtaaaggtccgtacggggaaccacggtacggactaccggcttacggaaccncgttacgaaggttcggtaccggaacccgtcgggtccgttaggtagggttaacgtacgggtaacggtaccgtaaacgttaaccgtttaacggttttaacggttccggtaaccgggtaacggggtaacccgggttttaacggggaaccggttaaacgggttaccggtaccggttccggtttacgggggttacggtttaccggggttttaaccgggggaccgggggtaaacggggttaacccggtaacgggttacccggtaccgggtaacccccgggtttaccgggttaacccgggttaaccggaccccgggtacccccggtaaccgggtcccggttccccccgggtacccccggtttaccccggg

SEQ ID NO: 148124 - DNA, 944 bp, Homo sapiens
  misc_feature: GYAE6OF01AKDCE.10.4.A04.1.454.CMB.1.raw
tcagcatagtagtgcacgaccggtgctcgatttagagtagtgatcgaggggctgggcctcaggaagcagcatcggaggtgcctcagccatggcatggatccctctcttcctcggcgtccttgcttactgcacagcagtcccggtggcccttcctcgtcgacccttgacctcacgcccaccctcactggtcccgtgtccgccgaagggacgacgaccacgcccctaacctatttacagtcgaccttcggtagggaacgaacggttccggttacgacggtaccgtaaagtttaaacgtttttcggtttaccggttagggttaaattaaaaccgtaggtaaaccggttccgaacggggtaccccaacggttccggcccggtttgggtttcgggtttaccgggtacctacctttaccgtaacgtttaaacaaaaacgtttacgtttaaacgggcccgggttacccccgtacgggtaccgggggttaccccgtaggtaacggtaccggtaacttccgtacggttccggacccggtacccgtacgggttccggtaccggggaccgtaaccggacgggtacccgtacccggtaccgttaacgtaaccccggtagttaccggtacgggtttaccggttaacccccggtaaccccgggtacgggttccggttcgggttaacggggtaacgggtacgggtaaccgggaacgttaaaccggttaaccttttaacggttaacgtttaccgggttacgggtaaccgggtacggggtaaccgggtaacggtacgggttaacggccgggtttcggtacggtttacgggttacgggtttcccggggaaccggggtaccgggtaaccggtacggtcccggtacccgggtccgttacccgggtacggaccgggtacccggacccggttaccgggtccccttcccgggtcccccgttacccgg

SEQ ID NO: 148125 - DNA, 767 bp, Homo sapiens
  misc_feature: GYAE6OF01A94AT.10.4.A04.1.454.CMB.1.raw
tcagcatagtagtgcacgaccggtgctcgatttagagtagtgatcaggggctgggcctcaggaagcagcatcggaggtgcctcagccatggcatggactccctctcttcctcggcgtccttgcttactgcacagcatccgtggcctccgtctcgacctgactcacgcccaccctcacgtcgtccgtgtaccgccgaaggacgacgaccacgtcccaacctattaccagtcgccttcgtagggaagtaacggtcggttaggaacgtacgtaattaaagttttggtttacggtaggtaataaaacgagtaacggtcgacggcctaggtccgaccgttggttcggttacggtactaatacttaataacctaaaagttacgtaacgggcccgtacccgtacggtaaccggggtttcccaggacgtacgtaaactccgtacggtacggaccgtacccgtaaaggtcccggtacgggaaccctaacggacggaccaccgggtacgtaccgaaccgttacgtaccgtaacgggttacggtacccggtaaccccggtaagggtccggttaggtacgggacggtacgggaacggtaacgtaacgtacgtttaacgttacggttcggtacggacgggtcggtacgggaacgtaggtacgcgtgtacggtacggtacggtttccggacgggtaacggtaccgtacggtaccgtacggtacccggttacggtacgacccgtaaccgaccgtaacggccgtcccggtccccgttaccggg

SEQ ID NO: 148126 - DNA, 719 bp, Homo sapiens
  misc_feature: GYAE6OF01AYCWW.10.4.A04.1.454.CMB.1.raw
  modified_base (649)..(649): a, c, t, g, unknown or other
  misc_feature (649)..(649): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggccctcctctgacctgactcacgcccaccctcactcgtccgtgtccgccgaggagacgacacgccctaaccatttaccatcgaccttcgtagggaagaacggtcggttagaagtacgtaaatttaaacgttttggtttacgttaggttaaataaaacgaggtaagtcgacggccagtcgccttggttcgttggtcacgttactataacaaaacttagttaacggccggtaccctacggtaacggggtccctacggacgtacggtaacgtccgtacggtcggtaccgaccgtaaacggtcgtacgggggaacctaacggtacggaccacggtcaccgtaccgtaattccgaggttaccgtaccggtaaccccgaagggtccttagggtcggtacgtggtaacggacccgtagtaacgtttacgttacggtcgttacggagggttccggtaacgggacgttacggtaggtctacgttggtacgttacgggtccgggtacggacgggaacncggtaccgttcggaacccgttcggtaacggccgtaaccgaccggacggttccgccccgtcccggtaccgg

SEQ ID NO: 148127 - DNA, 723 bp, Homo sapiens
  misc_feature: GYAE6OF01EUVHB.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggccctcctctgacctgactcacgcccaccctcactcgtccgtgtccgccgaggagacgacagcccaacctattacatcgctcgtaggagaaggtcgttgagcgtaatttaaagttttgttcgtaggtaactaaaacgagtaagtcgacggccgtacgtccgtccgttggtttggttggttctaacgtcttaactaactaaaagttacgtttaacggccggtaccccgtacggtacggggtccctaggacgacgtaacttcgtcgtacggcctaccgtacggtccggacgggtaaacccaggtaccggcctacgggtcctacgaccctacgtacgtaggttcggtacccgaccggtacggcgttagggtacggtactagggacggacgtaacggtacttaacgttacgtcggtacggtacgggtaccggtagggaacgtagggtacgtcggttcggttagttacggtagggtttaccgggacggggtaaccgggtaaccgtaacggtccgtaccgggtacccgttccgttaacgggcccgaaccggtacccgaaccggtcccgtcccggtacccccgttccgg

SEQ ID NO: 148128 - DNA, 737 bp, Homo sapiens
  misc_feature: GYAE6OF01CTZ6C.10.4.A04.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
tcagcatagtagtgcacgaccggtgctcgatttagagtagtgatcgaggggctgggcctcgaggaagcagcagtcggaggtgcctcagcctagtggcagtggacttcccttctcttcctcggtcgttccttgtaccttcgtcgacacagctacgttccgtcggtcccttcctcgtcgtacctcgtactccgaccgccctaccctcacgttcgtccgtgtcgcgaggagagcgacnccaactatacnttcgctcgtaggaggagtcgtgacgtaacgtaatttaaacgtttgtttacggtaagtaaacgtaaacgtagtaacgtcgaacgtcgtacgttcgtcgtttggtcgttagtctagtaactaagtaaactaaagtacgtaacgccggtccggtacggtacgggtaccttaggtccgttccggtttctcgtcgtacctacgtacggttcgacggtaccaccgaccgtcccttcgtacccggtcgtccgtcggtcgtccgtacgtacggtacggtacggtggtaacgtcggacgtacgtaaggttacttaacgtcgtcgacgtcgcgtaacgttacgttacgtaccggtaccgggtaccgtaacggggttacggttcgggttcgggaacgggtacggtacggttaccggtcggtaccggtccggtacggaccgtccggtcccgtaccggtcccgtacccgtcccgtaccggtccgttaccgttcccgtaaccccg

SEQ ID NO: 148129 - DNA, 680 bp, Homo sapiens
  misc_feature: GYAE6OF01EUSDD.10.4.A04.1.454.CMB.1.raw
  modified_base (129)..(129): a, c, t, g, unknown or other
  misc_feature (129)..(129): n is a, c, g, or t
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (173)..(173): a, c, t, g, unknown or other
  misc_feature (173)..(173): n is a, c, g, or t
tcagcatagtagtgcacgaccggtgctcgatttagagtagtgatcgaggggctgggcctcaggaagcagcatcggaggtgcctcagccatggcatggactccctctcttcctcggcgtccttgcttacngcacagcagtccgtgcctcctntgacctgactcacnccaccctnacgtgtccgtgccgcaaggcacgacacgccaacctattacatcggcttacgtaggaagagtcgttagacgtacgtaattaaagttttcgtttacggtagtaactaaacgagtaacgtacgacgtccacggtcgtcgtgtcggtagtacctattacgtaactaactaaaattacgttaacgccgccttacggcgggtcctaggactacgaagtcgtacgtcggactacgaacgttcgacggaccacggagccacggctagacctatacgacgttcgacgaccgaacggtctacgggtagaacgtgggaacgacgtaacgttataactttacgggttcaacgggtaggcgggtacgaacgtaggacggtcttacggtcggttacgtaaggggtttcccggaaacgggggtaccggaaacctcgggttacttaccggacccggtttaaggtacccggaccgtaaccgggacccgttaaacccggccgttccccgggttaaccccggtacg

SEQ ID NO: 148130 - DNA, 861 bp, Homo sapiens
  misc_feature: GYAE6OF01B2LW1.10.4.A04.1.454.CMB.1.raw
  modified_base (127)..(127): a, c, t, g, unknown or other
  misc_feature (127)..(127): n is a, c, g, or t
  modified_base (599)..(599): a, c, t, g, unknown or other
  misc_feature (599)..(599): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttacngcacagcactcccgtggccctcctcgtacgacctgactccacgcccaccctcactcgtccgtcgtccgaccgaggacgacgacacgacccactacttacagtcgccgtcgtaggaacgtacggtcggtacgaaggtacttaagttttaaagttttcggttttacggtagttaaactaaaacggaagtaacgtaccgacggtacctaggtccgccgttggtttacggttacggtaccttaattaccgtaaattaaaccgtaaaaagtttaccgttaaccgggcccggttaaccccgttaccggggtaaccgggtttccccgtaggaaccgttacgtaaccttccgggtccgtcgggacccgtaaccgtaacggtccggaccgggtaacccacggcgacccgtacgtccgtacgacctacggttcgaacggttccgtaaccgacccgtacgggtacgtacgggtacgggttacncgggtaaacgcgttaaacgtttcgtttaacctcgggttacggtaacggtacgggtaacggggtacgggtaaacgtacgggttaccggttccgtacgtttacggttaaccgggttccggggttaccgggggacgggttaacccgggtaacggtacccgggttacccgttcccggggtacccgttacccgggttaacgggacccgttacccccgggttaaacccgccgggttccccccggttccggttacccccccggtacccg

SEQ ID NO: 148131 - DNA, 780 bp, Homo sapiens
  misc_feature: GYAE6OF01DLALE.10.4.A04.1.454.CMB.1.raw
tcagcatagtagtgcacgaccggtgctcgatttagagtagtgatcgagggggctggggcctcaggaagcagcatcgggaggtgcctacagccatggcatggactccctctccgttcctcggcgttccttgccttactgacacgagcacgtcccggtggcccttcctcgtcgaccttgacctcgaccgccctaccctcgacgttggtcccggtgtaccgccgaggggacgacgaccgacgacccacctattaccgattcgccttcgtaggtaagacgtgttagagacgttaatttaaggtttcgtttcggtagtaaactaaagacgtaacgtacgaccggactacggtccggtcggtttggttacggtttggtacctacttacttaactaaacgtaaaactttaacgtaaccgggtacccgggtacccggtaccggtaccggggttcccgtaggtaccggtacgtaccgttaccgtacggtcgggtaccgtaaaccggtacggtccggtaacccggggacctaacggaccggtaccgtaccgacgttacggaccgtacgtacgtacggtacggtaccgaaccggtcgtacggtcggtaggtacgtaggacggactaacgttacgttacgtaggtaggacggacgggagtacggtacggtaggtacgtcgttcggtaggttcgttacggggttacgggacgggtaacggacctacgggtacctacgggtacctacggtacgaccgtaccgaccgtaccgggtcccgcccgttccggtaaccg

SEQ ID NO: 148132 - DNA, 483 bp, Homo sapiens
  misc_feature: GYAE6OF02F1IW5.10.4.A04.1.454.CMB.1.raw
tcagcatagtagtgcacgaccggtgctcgatttagagtagtgatcagggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgatttcggcggagggaccgaagctgaccgtctaggtcagccaaggctgcccctcgg

SEQ ID NO: 148133 - DNA, 509 bp, Homo sapiens
  misc_feature: GYAE6OF02G0W2N.10.4.A04.1.454.CMB.1.raw
  modified_base (431)..(431): a, c, t, g, unknown or other
  misc_feature (431)..(431): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgttcgtggtataaacagaagtcaggccagtcgcctgtgttggtcatctatcaaaatattaagcggccctcgaggggtccctgagcgaatctctggcgccaagtctgggaccacgaggcacgctgaccatcagtgtcgacccaggctggtggatggaggcagactattactgtcgaggcgtgggacaggtagcgngtgtgtagtttcgggcggagggaccgaaggctacggacccgtccgtaggtcacggcccgaaggcctccggcccctcgg

SEQ ID NO: 148134 - DNA, 545 bp, Homo sapiens
  misc_feature: GYAE6OF02H5EJV.10.4.A04.1.454.CMB.1.raw
  modified_base (299)..(299): a, c, t, g, unknown or other
  misc_feature (299)..(299): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtaataaacagaagtcaggccagtcgcctggtgttggtcatctatacaaaattnttaaagcggccctcgaggggtccctggagcgaatctctggcgcaagtctggggaccacgaggcacgctgaccatcagtgtgacccaggctgtggatgaggcagacttattactgtcgaggtcggtgggacagtagcgcgtgtgtacgttttcgggcgggtacgggaccgaaggccgttacggacccggttccgtacgggtaccgacggaccccgaagggtcccgtcccggtcccccgttacccggg

SEQ ID NO: 148135 - DNA, 486 bp, Homo sapiens
  misc_feature: GYAE6OF02FSK92.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctggggaccacaggcacgctgaccatcagtgtgacccaggctgtggatgaggcagactattactgtcaggcgtgggacagtagcgctgtgattttcggcggaggaccaagctgaccgtctaggtcagcccaaggctagcccctcgg

SEQ ID NO: 148136 - DNA, 519 bp, Homo sapiens
  misc_feature: GYAE6OF02I3BT4.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcgcctcaggggtccctgagcgaatctctggcgccaagtctgggaccacaggcacgctgaccatcagtgtgacccaggctgtggatgaggcagactattactgtcaggcgtgggacgagtagcgcgtgtgtagttttcggcggacgggaccgaaggcctacggtacccgttccgtagggtccgacggaccccgtaaggcccgtaccggtcccccgtccgg

SEQ ID NO: 148137 - DNA, 508 bp, Homo sapiens
  misc_feature: GYAE6OF02I48J4.10.4.A04.1.454.CMB.1.raw
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctgganaagcgttgagcgataaatttgttcgtggtataaacagaagtcaggccagtcgcctgtgttggtcatctatcaaaatnttaagcgcctcaggggtccctgagcgaatctcnggcgccaagtctgggaccacaggcacgctcgaccatcagtcgtgacccaggctgnggatgaggcagactattactgtcaggcgtgggacagtagcgctgtgtagtttcgggcggagggaccaaggcctggacccgttccgtaggtcacggacccgtaacggcctacggcccccgttacggg

SEQ ID NO: 148138 - DNA, 508 bp, Homo sapiens
  misc_feature: GYAE6OF02IG0LT.10.4.A04.1.454.CMB.1.raw
  modified_base (170)..(170): a, c, t, g, unknown or other
  misc_feature (170)..(170): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagagcgttgagcgataaatttgtttcgtggtataaacagaagtcaggccagtcgcctgtgttggtcatctatcaaatattaagcgcctcgacggggtcctgagcgaatctctggcgcaagtcgtgggaccacgaggcacgctgaccatcagtgtcgacccaggctgtggatggacggcagactattacngtcgaggngtgggacagtagcgcgtgtgtagtttcggcggacgggaccaaggcgtcggaccgtccgtacggtcacggacccgtaaggcctccgacccccgtcgg

SEQ ID NO: 148139 - DNA, 495 bp, Homo sapiens
  misc_feature: GYAE6OF02IPOPU.10.4.A04.1.454.CMB.1.raw
  modified_base (334)..(334): a, c, t, g, unknown or other
  misc_feature (334)..(334): n is a, c, g, or t
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcnccaagtctgggaccacaggcacgctgaccatcagtgtgacccaggcctgtggatggaggcagactattactgtcgaggcgtgggacagtagcgntgtgtagtttcggnggagggaccaaggctggaccgtcgtaggtcacgcccgaaggctcgcccctcgg

SEQ ID NO: 148140 - DNA, 509 bp, Homo sapiens
  misc_feature: GYAE6OF02HNUNO.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacaggtagcgctggtgtagttttcggcgggagggaccgaaggccgtggacccgtccgtaggtccaggcccgaaggtccgtcggccccctccggg

SEQ ID NO: 148141 - DNA, 495 bp, Homo sapiens
  misc_feature: GYAE6OF02FRNLZ.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgttcgtggtataaacagaagtcaggccagtcgcctgtgttggtcatctatcaaaatattaaagcggccctcaggggtccctgagcgaatctctggcgccaagtctgggaccacaggcacgctgaccatcagtgtgacccaggctgtggatggaggcagactattactgtcagggcgtgggacaggtagcgctgtgagtttcggcggaggaccgaaggctcggaccgtcgtaggtcacgcccgaaggctcgcccctcgg

SEQ ID NO: 148142 - DNA, 511 bp, Homo sapiens
  misc_feature: GYAE6OF02GIGK1.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggcatctatcaaaataattaagtacggccctcaggggtcccgtcgagcgaatctctggcgccaagtcgtgggaccacaggcacgctgaccactcagtgtgacccaggcgtgtggagtgaggcagactattactgtcaggcgtgggacagtagcgctgtgagtttcggcggagggaccgaaggcctggaacccgtcgtaggtcgacggcccaagggcctcggcccccgttccgg

SEQ ID NO: 148143 - DNA, 512 bp, Homo sapiens
  misc_feature: GYAE6OF02IE7JD.10.4.A04.1.454.CMB.1.raw
  modified_base (334)..(334): a, c, t, g, unknown or other
  misc_feature (334)..(334): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtccgcctgtgttggtcatctatcaaaatattaagcggcctgaggggtccctgagcgaatctctggcnccaagtctgggaccacgaggcacgctgaccatcagtgtcgacccaggctgtggatggaggcagactattactgtcgaggcgtggacgaggtagcgctggtgtagtttcgggcggagggaccgaaggccgtacggacccgttccgtaggtcacggacccgaaggctccggcccctccgg

SEQ ID NO: 148144 - DNA, 528 bp, Homo sapiens
  misc_feature: GYAE6OF02I535D.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgttcgtggtataaacagaagtcaggccagtcgcctgtgttggtcatctatacaaaatattaaagcggcctcgacggggtccctgagcgaatctcgtggcgccaagtcgtcgggaccaacgaggccacgctcgaccatcgagtgtcgacccaggctgtggagtggacggcgagtactacgtttactgtacgagggtcggtagggacgtaggtacggcgcgtgtggtagtttcgggcggaggaccgaaggacgtggaccgtcgtaggactacgccgaggcctcgccccgtcgg

SEQ ID NO: 148145 - DNA, 493 bp, Homo sapiens
  misc_feature: GYAE6OF02F4N2N.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggcctcaggggtccctgagcgaatctctggcgccaagtctgggaccacgaggcacgctgaccatcagtgtgacccaggctggtggatggaggcagactattactgtcaggcgtgggacagtagcgctgtgtagtttcggcggaggaccgaagctcggaccgtcgtaggtcagcccgaggctcgccccgtcgg

SEQ ID NO: 148146 - DNA, 502 bp, Homo sapiens
  misc_feature: GYAE6OF02GCUOI.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcgcctcaggggtccctgagcgaatctctggcgccaagtctgggaccacgaggcacgctgaccatcagtgtgacccaggctgtggatgaggcagactattactgtcaggcgtgggacaggtagcgctgtgtagtttcgggcggagggaccgaaggctcggacccggtccgtaggtcacggcccgaaggcctcgcccccgtcgg

SEQ ID NO: 148147 - DNA, 524 bp, Homo sapiens
  misc_feature: GYAE6OF02G91CG.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtccgccaggagagacagccaccattacatgctctggagaagcgttgagcgataaatttgtttcgtggtataaacagaagtcaggccagtcgcctgtgttggtcatctatcaaaatattaagcgcctcgaggggtccctgagcgaatctctggcgccaagtctgggaccacgaggcacgctagaccatcagtgtcgacccaggctggtggatggaggcagactattactgtcgagggcgtgggacaggtacgcgcgtgtgtagttttcgggcgggtagggaccgaaggtcgtacggacccgttccgtaggtccacggacccgaaggccgtccgcccccgtccgg

SEQ ID NO: 148148 - DNA, 577 bp, Homo sapiens
  misc_feature: GYAE6OF02FU751.10.4.A04.1.454.CMB.1.raw
tcagcatagtagtgcacgaccggtgctcgatttagagtagtgatcgaggggctgggcctcaggaagcagcatcggaggtgcctcagccatggcatggatccctctcttcctcggcgtccttgcttactgcacagcatccgtggcctcctctgacctgactcagcccaccctcactgtccgtgtccgcaggagagacagcccactattacatgctcgtggaagaagtcgttgagcgtaattaaatttgtttcgtggtaataaacgagaagtcgaggccagtccgcctgtgttggtcatctatacaaatataacgcgtccctcgacggggtcctgacgcgaatctcgtggccgaccgaagtcgtacgggaccacgacggcacgctacgacctatcgagtgtcgacccgaggcgtgtggagtggagcgagtacttattacgtacgtcgaggtcggtagggacgtaggtacggtcgcgttggtgttacggttttcgggacgggtacgggaccgaacggtccgtacggtaccgttccgtacggtacgacggacccgacggtccgtcccgtccccgtacccgg

SEQ ID NO: 148149 - DNA, 528 bp, Homo sapiens
  misc_feature: GYAE6OF02GEKX2.10.4.A04.1.454.CMB.1.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctgganaagcgttgagcgataaatttgttcgtggtataaacagaagtcaggccagtcgcctgtgttggtcatctatcaaaatnttaagcggccctgaggggtccctgagcgaatctctggcgacccaaagtcgtacgggaaccacgagggctacgctgaccatcagtcgtgacccaggctgtggatgaggcagactattactgtcgaggcgtggacaggtagcgtcgtgtgtagttttcgggacgggagggaccgaaggcctaggtacccgtaccgtaggtcgacggtacccgaaggccgtaccgcccccgtaccgg

SEQ ID NO: 148150 - DNA, 507 bp, Homo sapiens
  misc_feature: GYAE6OF02FS1AE.10.4.A04.1.454.CMB.1.raw
  modified_base (307)..(307): a, c, t, g, unknown or other
  misc_feature (307)..(307): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcgccctnaggggtcctgagcgaatctctggcgccaagtctgggaccacgaggcacgctgaccatcagtgtcgacccgaggcgtgtggatggaggcagactattactgtcgaggcgtgggacgagtagcgcgtgtgtagttttcggcggagggaccgaaggctcggaccgtccgtaggtcgacgcccgaaggccgtcgccccgtccgg

SEQ ID NO: 148151 - DNA, 560 bp, Homo sapiens
  misc_feature: GYAE6OF02G0400.10.4.A04.1.454.CMB.1.raw
tcagcatagtagtgcacgaccggtgctcgatttagagtagtgatcgggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgaataaatttgttcgtggtaataaacagaagtcaggccagtcgcctgtgttggtcatctatacaaaatattaagcgccctgacggggtccctggacgcgaatctcgtggccgccaagtcgtacgggaccacgaggcacggctagaccatcagtgtcgacccgaggctggtggatggaggcagtactagttactggtcgagggtcggtagggacgtaggtacggcgtcgttggtgttacgtttcggggacggtacgggaccgaaggtccgtacggtacccggtcgtacggtacgaccggaccgaacggtccgtccggtcccccgtcggtcccg

SEQ ID NO: 148152 - DNA, 537 bp, Homo sapiens
  misc_feature: GYAE6OF02H1EWC.10.4.A04.1.454.CMB.1.raw
  modified_base (329)..(329): a, c, t, g, unknown or other
  misc_feature (329)..(329): n is a, c, g, or t
  modified_base (408)..(408): a, c, t, g, unknown or other
  misc_feature (408)..(408): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagccggcctcaggggtccctgagcgaatctntggcaccaagtcgtgggaccagaggcacgctgaccatcagtgtgacccaggctggtgatgaggcagtactatacgtgtnaggcggtaggacaggtagcgtcgtaggtgtagttttcgggacggtagggaccgtaaggccttacggtacccggtacccgtagggtacccgtaggccccgaagggtccgttaccggcccccgttaccggg

SEQ ID NO: 148153 - DNA, 613 bp, Homo sapiens
  misc_feature: GYAE6OF02GY5B1.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccacctcactgtcgtcgtcgccgacgaggagacgacgccgaccactactactgctcctggaggaagacgtgtagacgacgtaaatttaagttttcgttcggtagttaaactaaacgaagtacgtaggacgacgtacgtcctcgtaggttggttcggatactatactaaaactaaattaagtacggcccgtcctaggggtacccgtcgagacgactactctcggcgccaacgtacgtcgggacgaccaggacgacgcgtcgaccactcgagtagtgaccccgagcgtgttggagtagtaggcgagactatttacgtacgtcggaggacggttggggaacgtacgtaaggcgccgtgttgtagttttcggtcggggacgggacctaaggaccgtcggtaccggtacccgttaggtcgacgccccgaacgggacgttccgccccccgtcccggg

SEQ ID NO: 148154 - DNA, 588 bp, Homo sapiens
  misc_feature: GYAE6OF02IONC6.10.4.A04.1.454.CMB.1.raw
  modified_base (214)..(214): a, c, t, g, unknown or other
  misc_feature (214)..(214): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtccgccaggagagacagccacattacatgctcnggagaagcgttgagcgattaaatttgttcgtggtaataaacagaagtcaggccagtcgctgtgttgtcatctatacaaatattaagcgcctcgacggggtcctgagcgtaatctcgtggccgaccgtaaggtccgtacgggaccctaacgacggccgacgccgtacgaacccgatacgtacgtcggtacgacccgacggtcgtaggtaggagtggacgcgaagtacttagttacgtgtacgaggtcggtacgggacgtaggtacgcgtcgtggtcgtacggtttcgggacgggtaacggaccgtaacgtccgtacggtacccgtacgtacggtaccgacggtacccgaacggtccgtacccgtccccgtaccgg

SEQ ID NO: 148155 - DNA, 515 bp, Homo sapiens
  misc_feature: GYAE6OF02IPROA.10.4.A04.1.454.CMB.1.raw
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctgganaagcgttgagcgataaatttgttcgtggtataaacagaagtcaggccagtcgcctgtgttggtcatctatcaaaatnttaagcgccctnaggggtccctgagcgaatctctggcgacaagtctagggaccacgaggcacgctcgaccatcagtgtcgacccgaggctgtggagtgagcagactattactgtcgaggcgtgggacaggtagcgcgtgtgtagtttcggcggaggtaccgaggtcctacggtaccgtccgtacggtccgacggacccgaaggccgtccgcccccgtccgg

SEQ ID NO: 148156 - DNA, 556 bp, Homo sapiens
  misc_feature: GYAE6OF02HOOVO.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtcccgtgtcgccaggagagacagccaccattacatgctctggagaagcgttgagcgataaatttgtttcgtggtataaacagaagtcaggccagtcgcctgtgttggtcatctatcaaaatattaagccggccctcgaggggtccctgaggcgaatctcgtggccgcgaagtcgtgggaccacgaggcacgctcgaccatcagtgtcgacccgaggctggtggagtggacggcagtactagttactggtacgagggtcggtgggacgtaggtacgcgtcgtggtgtagttttcgggcgggtacgggaccgaaggtccgtacggtacccggttccgtacggtccgacggtcccgaacgggtccgtccggtcccccgttccgg

SEQ ID NO: 148157 - DNA, 517 bp, Homo sapiens
  misc_feature: GYAE6OF02GK7UP.10.4.A04.1.454.CMB.1.raw
  modified_base (170)..(170): a, c, t, g, unknown or other
  misc_feature (170)..(170): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctnactgtccgtgtcgccaggagagacagccaccattacatgctctggagaagcgttgagcgataaatttgtttcgtggtataaacagaagtcaggccagtcgcctgtgttggtcatctatcaaaatattaagcggcctcgacggggtccctgagcgaatctctggccgccaagtctcgggaccacgaggcacgctgaccatcagtgtacgacccaggctggtcgatggaggcagactatactgtcgaggcgtggacagtagcgtctgtgtacgtttcgggacggacggaccaaggtctcggacccgttcgtaggtcacggacccgaaggtccgtccggcccccgtacgg

SEQ ID NO: 148158 - DNA, 531 bp, Homo sapiens
  misc_feature: GYAE6OF02I0XVK.10.4.A04.1.454.CMB.1.raw
  modified_base (190)..(190): a, c, t, g, unknown or other
  misc_feature (190)..(190): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccagganagacagccaccattacatgctctggagagcgttgagcgataatttgttcgtggtataaacagaagtcaggcagtcgcctgtgttggtcatctatacaaatattaagcgcctcgacggggtcctgagcgaatctctggcgcaagtctggaccacgaggcacgctcgacctatcgagtcgtacgacccgaggctggtgacgtggacggcagtactagtactagtacaggtcgtaggacgtagtcgcgtcgtgtagtagtttcgggacggtaggaccgaagtccgtcggacccggttacgtacgggtaccacggacccgtaaggccctacggcccccgttacgg

SEQ ID NO: 148159 - DNA, 518 bp, Homo sapiens
  misc_feature: GYAE6OF02G7ACA.10.4.A04.1.454.CMB.1.raw
  modified_base (373)..(373): a, c, t, g, unknown or other
  misc_feature (373)..(373): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtccgccaggagagacagccaccattacatgctctggagaagcgttgagcgataaatttgttcgtggtaataaacagaagtcaggccagtcgcctgtgttggtcatctatacaaaatataagcggcctcgagggtccctgagcgaatctctggcgccaagtctgggacccacgaggcacgctgaccatcagtgngacccaggctgtggatgaggcagtactattactgtcgaggtcggtgggacaggtacgcgtcgtgtacgtagtttcgggcggaagggaccaaggcctaggacccgttcgtaggtccgacgcccgaaggcccgtcggcccccgtcgg

SEQ ID NO: 148160 - DNA, 530 bp, Homo sapiens
  misc_feature: GYAE6OF02HX8YI.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgattaaatttgtttcgtggtataaacagaagtcaggccagtcgcctgtgttggtcatctatcaaaatattaagcgcctgaggggtccctgacgcgaatctctggcgccaagtcgtgggaccacgaggcacgctacgaccatcagtgtacgaccgaggctggtggatgaggcagacttattactgtcgaggcgtagggacgaggtagcgtcgtgtgtagtttcggacgggtagggaccgaaggtcgtacggacccgttccgtaggtaccgacggacccgtaaggcctccggcccccgtaccgg

SEQ ID NO: 148161 - DNA, 521 bp, Homo sapiens
  misc_feature: GYAE6OF02GAUIT.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcgcctcaggggtccctgagcgaatctctggcgccaagtctgggaccacacggcacgctgaccatcagtgtcgacccaggctgtggatgaggcagactattactgtcgaggcgtagggacagtagcgtcgtgtgtagttttcgggacggtagggaccgaaggtccgtacggacccgttccgtaggtccacggacccgaacggccgtccgcccccgttaccgg

SEQ ID NO: 148162 - DNA, 655 bp, Homo sapiens
  misc_feature: GYAE6OF02GMDQ3.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggccctcctctgacctgactcagcccaccctcactgtccgtgtcgccaggagagacagcccaccattacatgctctggagaagcgttgagcgtaattaaatttgtttcgtggtaataaacagaagtcaggccagtcgcctgtgttgtcatctatacaaaatagttaacgcggcctcgacggggtccctaggacgacgtaatcgtcgtggaccgcctaaggtcgtacggggaacccaacgcggaccacggctacgaacctactacgacgtacggtacggacccgagggccgtggtagggtagtggacgggtcgtaacggtaacttaacgtttacgtcggtacggtacgggtaccgggttagggaccgtaaggttacggccggtcgttaggttacgttacggttttaccgggcggggtaacgggtaaccgtaacggtaccggttaccgggacccggttaccgtacggtaccgaccggaccccggaacggtacccgtcccggtcccccgttacccggg

SEQ ID NO: 148163 - DNA, 588 bp, Homo sapiens
  misc_feature: GYAE6OF02H205G.10.4.A04.1.454.CMB.1.raw
  modified_base (171)..(171): a, c, t, g, unknown or other
  misc_feature (171)..(171): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctnactgtccgtgtcgccaggagagacagccaccattacatgctcgtaggagaagcgttgagcgattaaatttgtttcgtggtataaacgagaagtcaggccagtcgcctggttgttggtcatctatacaaatattaagccggcctcgacggggtccctagagacgatctcgtggccgcgaacgtcgtacgggaccacgacggacacgcgtacgacctacgtaccgtaggttcggtaccgacccgtagggtcttgggtacggagttaggacggtacagtaaccttattacgtagtcgagggtcggtaggactaggtacgcgtcgtggtcgttacggtttcgggacgggtacgggtaccgaagtcgtacgacccgttcgtacggtcgacggacccgtaggcccgtccggtccccgtaccgg

SEQ ID NO: 148164 - DNA, 509 bp, Homo sapiens
  misc_feature: GYAE6OF02FLJTP.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagcccacattacatgctctggagaagcgttgagcgataaatttgtttcgtggtataaacagaagtcaggccagtcgcctgtgttggtcatctatcaaaatattaagcgccctgacggggtccctgagcgaatctctggcgccaagtctgggaccacgaggcacgctagaccatcagtgtcgacccaggctgtggatggaggcagactattactgtcgaggcgtgggacaggtagcgtctgtgtagtttcgggacggagggaccgaaggctggacccgtcgtaggtcacggcccgaaggcctaccggccccgtcgg

SEQ ID NO: 148165 - DNA, 560 bp, Homo sapiens
  misc_feature: GYAE6OF02I822Z.10.4.A04.1.454.CMB.1.raw
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattaccatgctctggganaagcgttgagcgataatttgttcgtgtataaacagaagtcaggccagtcgctgtgttggtcatctanacaaatattaagcggccctcgacggggtccctagacgacgaatctacgtcggcgccaaggtctcgggaccacgagggaccacgctacgacctactccgagtgtacggacccagggctggtggatgaggcagtactattactcgtcgaggtcgtgggtacagggtacgcgtacgttgtgttacgtttcgggagggacggaccgaaggtaccgtcggtaaccggttccgtacggtccacggtcccgaacgggtccgttcccggtcccccgtaccgg

SEQ ID NO: 148166 - DNA, 565 bp, Homo sapiens
  misc_feature: GYAE6OF02G7AAF.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgattaaatttgttcgtggtaataaacagaagtcagccagtcgctgtgttggtcatctatacaaaatattaagcggtccctcgacggggtccctgacgacgtaatcgtcgtggaccgccgaagtccgagggacccacgaggccacgctagaccatcgagtcgtcgacccaggctggtgagtggagcgagtactagttactgtcgaggtcggtaggtacgagtagcgtcgtggtacgtagtttcgggacggtacgggaccgaacggtccgtacgggtacccgtaccggtacggtaccgacggacccgtaacggtccgttcccggtcccccgttacccgg

SEQ ID NO: 148167 - DNA, 565 bp, Homo sapiens
  misc_feature: GYAE6OF02GL414.10.4.A04.1.454.CMB.1.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatcccgtggcctcctctgacctgactcagccaccctcactgtccgtgtcgccaggagagacagccaccattacatgctcgtggagaagcgttgagcgattaaatttgtttcgtggtaataaacgagaagtcaggccagtcgcctggtgttggtcatctatactaaaatattaacgccggtccctcgacggggtccctggacgcgtaatctcgtcggccgccgaagtcgtacgggaccacgacgggcaccgctacgaccatcgagtcgtacgacccgnggctgggngatggagcagtactagttactgtcgagggcgtaggacgtggtacgcgtcgttggtagtagtttcgggacgggtacgggtaccgagtccgtacggacccgttcgtaggtccaccggtacccgacggctacccggtccccgttaccgg

SEQ ID NO: 148168 - DNA, 521 bp, Homo sapiens
  misc_feature: GYAE6OF02GML4P.10.4.A04.1.454.CMB.1.raw
  modified_base (390)..(390): a, c, t, g, unknown or other
  misc_feature (390)..(390): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgctgtgttggtcatctatacaaaatattaagcggccctcgaggggtccctgacgcgaatctcgtggcgccaagtctagggaccacgaggcacgctcgaccatcagtgtcgacccaggctgnggatgaggcagactatactgtcaggcgtggactaggtagcgctaggtgtagtttccggacggacgggaccgaaggccgtacggacccgttacgtacggtcacggcccgaaggtccgtccgccccgtcgggg

SEQ ID NO: 148169 - DNA, 603 bp, Homo sapiens
  misc_feature: GYAE6OF02H0V0L.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtcgccaggagagacagccaccattacatgctctggagaagcgttgagcgaataaatttgttcgtaggtataaacgagaagtcaggccagtcgctgtgttggtcatctatacaaaattagttaagcggcctcgaggggtccctgagcgaatctcgtggcctcgaacgtcgtacgggaccacgacgggccacgctacgaccacgtcgaggtcgtacggacccgtagggcgtggtcggtacgtggaggcgaagacgtttactacgtggtacgtagggcggtacgggacgtaggtacggtacgtcgtaggttggttacgttttccggggacgggtacgggaccgtaacggaccgttccggtaaccggttaccggtacgggtaccgacggaccccgtaacgggtccctacccggtccccccgtccgg

SEQ ID NO: 148170 - DNA, 660 bp, Homo sapiens
  misc_feature: GYAE6OF02JL8CQ.10.4.A04.1.454.CMB.1.raw
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
tcagcatagtagtgcacgaccggtgctcgatttagagtagtgatcagggctgggcctcaggaagcagcatcggaggtgcctcagccatggcatggatccctctcttcctcggcgtccttgcttactgcacagcatccgtggcctcctctgacctgactcacgccaccctcactgtcccgtgtccgccagggagagacacgcccacattaccatcgcctctggaacgtacgtcgttgagcgtaattaagttttgtttcgtaggtaataaacgagtaagtcagtcacgtcgctggtgtgtcatctaatcaaaatntaagccgcctcgacggggtccctagacgacgtaagcttacgnggtccgacgtaacgtcgtacgggaacccacggaccggcgacgcgtcgaccactacgacgtcgtacgacccgacggtcgtacggtagggagtcggtacggaccgtaagaccgttacttaccgtacggtcggtaacgggtcgggtacgggaacgtaggtaacgtcggtacgtaggtacggttacggtttaccgggtacgggtaacggggaccgtaacggtaccggttaaccggtaccggttacccggttacggaccggtaccggacccggtaaccgggtcccgttacccggaccccccggttaccgg

SEQ ID NO: 148171 - DNA, 571 bp, Homo sapiens
  misc_feature: GYAE6OF02GF44S.10.4.A04.1.454.CMB.1.raw
  modified_base (406)..(406): a, c, t, g, unknown or other
  misc_feature (406)..(406): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgcaggagagacagccacattacatgctcgtggagaagcgttgagcgattaaagttgtttcgtggtaataaacagaagtcaggccagtcgctgtgttggtcatctatacaaaattataagccgcctcgaggggtccctggagcgaatcgtctggaccaccgtaagtcgtacgggaccctaacaggctacgctacgacctatcgaagtgtacgacccgaggctggnggataggacggcgaacgtacttaattacgtaggtcagggcggtagggacgtaggtagcgtctggtagtacgttttacgggccggaagggaccaaggtacgtccggtacccgttaccgtagggtccacggtacccggtaacggtccgtaccggtcccccgttacgg

SEQ ID NO: 148172 - DNA, 496 bp, Homo sapiens
  misc_feature: GYAE6OF02HLJWG.10.4.A04.1.454.CMB.1.raw
  modified_base (217)..(217): a, c, t, g, unknown or other
  misc_feature (217)..(217): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctgganaagcgttgagcgataaatttgttcgtggtataaacngaagtcaggccagtcgctgtgttggtcatctatcaaaatntaagcggccctnaggggtccctgagcgaatctctggcgccaagtctgggaccacaggcacgctgaccatcagtgtcgacccgagcgtgtggatgaggcagactattacngtcaggcgtgggacagtagcgctgtgtagtttcggcggtaggaccgaaggctacggaccgtcgtaggtcacggcccaaggcctcggcccctcgg

SEQ ID NO: 148173 - DNA, 619 bp, Homo sapiens
  misc_feature: GYAE6OF02GYB02.10.4.A04.1.454.CMB.1.raw
  modified_base (340)..(340): a, c, t, g, unknown or other
  misc_feature (340)..(340): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtccgccaggagagacagcccaaccattaccatgctcgtgggagaagtcgttagagacgtaattaaattttggtttcggtaggtaataaacgagtaacgtcgaggcagtcgcctgtgttggcatctatacaaatagtaacgccgtcctcgacgggtcccngacgacgtaactcgtcgtcggccgtaccgtaaggtccgtacgggacccaacgaggaccgtaccgcgtacgaccacgtacgacgtacgtaccgtaccgaggtcgtggtaggagtcggacggacgtaagtactaacgttacgtacgtacgacgggtacggtacgggtacaggtcgcgtcgttgtacggttacggtttcgggacgggtacggtaacgtacggtccgtacggtaccgttacgtacggtacaccggaccgtacggtccgtcccgtccccgtcgg

SEQ ID NO: 148174 - DNA, 702 bp, Homo sapiens
  misc_feature: GYAE6OF02F236T.10.4.A04.1.454.CMB.1.raw
  modified_base (218)..(218): a, c, t, g, unknown or other
  misc_feature (218)..(218): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagcccaccattacatgctctgganaagcgttgagcgataaatttgttcgtggtataaacagaagtcaggccagtcgcctgtgttggtcatctatactaaaatattaagccggtccctcgacgggggttccctaggacgcgtaatccgtcgttcgggccgaccctaaggtccgtacggggaaccctaccggagggacctaaccgcgtacgaacccagtaccgaggttcggtaccggacccgtaagggtccgttagggtacggagttacgggaacggtaccgacggttaaccgttaacgtttaaccgtcgggttaaccggacgggtaccgggttaggggtaaccgtaagggttacggccggttacgttcgggtaggtttaaccgtttttccggggacgggtaacggggtaacccgtaacgggtccgttacgggtaaccccgttcgttaaccgggtccgtaacggtacccccggaagggtcccgttacccgggtaccccccgttacccggg

SEQ ID NO: 148175 - DNA, 540 bp, Homo sapiens
  misc_feature: GYAE6OF02GEGN1.10.4.A04.1.454.CMB.1.raw
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagcccaccattacatgctctggagaagcgttgagcgataaatttgtttcgtggtataaacagaagtcaggccagtcgcctgtgttggtcatctatacaaaatnttaagcggcctgaggggtccctgagcgaatctctggcgccaagtcgtgggaccacaggcacgctgaccatcagtcgtcgaccaggctgtggatggaggcagtactaattactgtacgngggcgtggganacggtagcgtgtggttntagttttacgggcgggtacgggaccgaaggaccgttcggacccgttaccgtacggttccgacggccccgaacggtccgtaccggcccccgttccggg

SEQ ID NO: 148176 - DNA, 529 bp, Homo sapiens
  misc_feature: GYAE6OF02FUW1N.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccacattacatgctctggagagcgttgagcgataaattgttcgtggtataaacagaagtcaggcagtcgcctgtgttggtcatctatacaaaatataagcgcctcgaggggtccctgagcgaatctcgtggcgcaagtctagggaccacgaggcacgctcgaccagtcagtgtcgacccaggtctggtggatggaggcagactattactgtacgagggcgtgggactaggtacgcgtctggtgttacgtttcgggcggtacgggaccgaaggtcgtacggaccgtccgtacggtaccacggtacccgaaggtcccgtaccgcccccgtacggg

SEQ ID NO: 148177 - DNA, 697 bp, Homo sapiens
  misc_feature: GYAE6OF02FH66M.10.4.A04.1.454.CMB.1.raw
tcagcatagtagtgcacgaccggtgctcgatttagagtagtgatcaggggctgggcctcaggaagtagcatcggaggtgcctcagccatggcatggatccctctcttcctcggcgtccttgcttactgcacagcatccgtggcctcctctgacctgactcagcccaccctcactgtccgtgtccgccaggagagacacgccaccattacatgctcgtggagaagtcgttaggacgcgtaattaaatttggtttacgtggtaataaacagaagtcgacggccaggtcgtcctggttgttggtcatctatacaaaatattaacgccgcctcggtacgggtccctagacgacgaacttctcgtcggccgaccgaaggtccgtacgggacccaacgacggaccaccggtactcgaacctacgtacgaggttcgtacgacccgtaggtcgtggtaggtagtaggaggacgacggtaacttacgttacgttcggtacggtagggtacgggtacgggtaacgtaaggttacggtccggtaccggttcggttacggtttacgggttttaccggggaccggggtaccgggtaaccggtaacgggtacccgttaccgggtaaccccggttaccggtaccggtacccgtacccggaccccggtaacgggttcccgtaccccggttcccccggttacccggttaccccg

SEQ ID NO: 148178 - DNA, 703 bp, Homo sapiens
  misc_feature: GYAE6OF02JLUF5.10.4.A04.1.454.CMB.1.raw
  modified_base (212)..(212): a, c, t, g, unknown or other
  misc_feature (212)..(212): n is a, c, g, or t
tcagcatagtagtgcacgaccggtgctcgatttagagtagtgatcaggggctgggcctcaggaagcagcatcggaggtgcctcagccatggcatggatccctctcttctcgcgtccttgcttactgcacagcatccgtggcctcctctcgacctgactcacgccacctacactgtccgtgtcgccaggagagacacgccaccattaccagtnctactggagagtcgttgacgacgtataactttgttcgtggtaataacagtagtcgagcagtcgctgtacgttggctatctagtacaaaattagttaacgccggtaccctacggtacggggttaccctggaacgcgtaaattccttcggacggtaccgacgaaacggtttcgaccggggaacccacggtacggacccgacggtacttccggaacctactacgacggttcggtaccgaccggacggtacgttgggtacggtagtacgggtcggaaccgtacggtaaccgttaatttaccgttaggtacggtaacggggtacggtcgggtaacgttacgggtaacgtccgttcggttacgggttacggtacggttttccggggaacgggtcggggtaacccgtaagggtcttacccggggttaccttacccgggttaaggtcccgtaaggcccccgttaaagggtcccgttcccgggtacccccttacccgggg

SEQ ID NO: 148179 - DNA, 617 bp, Homo sapiens
  misc_feature: GYAE6OF02IHKQR.10.4.A04.1.454.CMB.1.raw
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctgganagcgttgagcgataatttgttcgtggtaanaacagaagtcagcagtccgcctgtggttggtacactctatacaaaattaattaaggccggccctacgtacgggggtccctaggacgacgaatctcgtggccaccgaagtcgtacgggaccagacggcacgctacggaccactccaggttcgtacgcccgtacgggtctgggtggtagtcgggaacgggactacgggtaaccttattacgtacggtacgacggggtacgggtacgggacgtaacggtagccgtcgtggtgttacggttttcgggacggggtacggaacgtaacggtcctccgggtaacccggttccgtaacggtcggaccgacccggtaaacgggtccctaccggtcccccgttacccggg

SEQ ID NO: 148180 - DNA, 669 bp, Homo sapiens
  misc_feature: GYAE6OF02FRF4H.10.4.A04.1.454.CMB.1.raw
  modified_base (500)..(500): a, c, t, g, unknown or other
  misc_feature (500)..(500): n is a, c, g, or t
tcagcatagtagtgcacgaccggtgctcgatttagagtagtgatcaggggctgggcctcaggaagcagcatcggaggtgcctcagccatggcatggatccctctcttcctcggcctcctctctcactgcacagactctgtgacctcctatgcgctgactcagcccaccctcggtgtcagtcggcccaggacagcggccacgctgacctggtgggggatacacaattggaagtaatcgtgtgctacgtggtaccagcaggacggccgaggccacggccccgtggtcggttgtcgtctataacgtgactaaccgccggtccctcgagggtactcccgtgacgcgtacttctcgtcggtcctaccgaacgttccgggactaaccgaccgggacccacccgtacactccacgtacccaaccggtggggtacccggaggggacccggggtagtcgggaacgggacccgtaacctacttaccgtgtacgtagggtcggtagggttntttaccgacgttacgtagtactacgtaacggttcggggttcggggttccgttacgggggaccggggacgggtaccgtacggtcggtaaccggacccggttaccgtaacggtccgaccggacccgaacgggttcccgtacccggtcccccggttgggtacccttaccccg

SEQ ID NO: 148181 - DNA, 755 bp, Homo sapiens
  misc_feature: GYAE6OF02IZ591.10.4.A04.1.454.CMB.1.raw
  modified_base (342)..(342): a, c, t, g, unknown or other
  misc_feature (342)..(342): n is a, c, g, or t
tcagcatagtagtgcacgaccggtgctcgatttagagtagtgatcaggggctgggcctcaggaagcagcatcggaggtgcctcagccatggcatggatccctctcttcctcgcgtccttgcttactgcacagcatccgtgcctcctctgacctgactcagcccaccctcactgtcccgtgtccgccaggagacgacacgccaaccattacatcgctctggagaagtcgttgagcgtaattaaagtttgtttacgtaggtaataaaacgagaacgtacgacggaccctaaggtccgtaccgtggtggtttacggtactaacttcttaactaacgtaaaaattnttaaacggccgtaccctcggacggggtcctagacgcgaactctacgtggaccgaccaaagttccgagggtaccaacgaggacacggctacgacctactacgtagtcgtacgacccgtaggtaccgtggtacggtagtacggtaacgggaccgtaacgtaaccgtttaacgtttaacctacgggttaccggtaacggggaccgggttaacggggaaccgtaacgggttacgggtaccggttaccgtacgggtttaacggttaccggtttttaccgggggaccggggtaaacggggtacccgtaaaacggggttccgtaaccggtaaccccgggtttaccgggtaaccgggttacccaaccgggtacccggtaaccgggttaccggttaccccgggtacccccgttaaccccggg

SEQ ID NO: 148182 - DNA, 587 bp, Homo sapiens
  misc_feature: GYAE6OF02G34H7.10.4.A04.1.454.CMB.1.raw
  modified_base (244)..(244): a, c, t, g, unknown or other
  misc_feature (244)..(244): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagacgcgtgagcaattaaatttgtttcgngtaataaacagtaagtcaggccagtcgcctgtgtgtcatctatacaaatatagccgcctcgacggggtcctgacgactactcgtcgtgaccgcgaacgtcgtacgggaaccacggtacggccacgccgtacgaccatcacggtgtaccgaccgaggccgtggtaggtagtaggacggtacaacgtacttagttacctggtaccgagggtccggtagggtaacgtaggtacgtcggtcgttggttaggtacggttttcgggacgggtgggtaaccggacgtaccgtacggtacccggtcgtaacggtcgaccggacccgacgtccggtcccgtccccgttccgg

SEQ ID NO: 148183 - DNA, 660 bp, Homo sapiens
  misc_feature: GYAE6OF02GYYUC.10.4.A04.1.454.CMB.1.raw
  modified_base (110)..(110): a, c, t, g, unknown or other
  misc_feature (110)..(110): n is a, c, g, or t
  modified_base (126)..(126): a, c, t, g, unknown or other
  misc_feature (126)..(126): n is a, c, g, or t
  modified_base (131)..(131): a, c, t, g, unknown or other
  misc_feature (131)..(131): n is a, c, g, or t
  modified_base (405)..(405): a, c, t, g, unknown or other
  misc_feature (405)..(405): n is a, c, g, or t
tcagcatagtagtgcacgaccggtgctcgatttagagtagtgatcaggggctgggcctcaggaagcagcatcggaggtgcctcagccatggcatggatccctctcttccncggctccttgcttacngcacngcatccgtggccctcctctgacctgactcagcccaccctcacttgtcccgtgtccgccgagggagagaccagcccaacctattaccatcgccttacgaggaagacgtcgttgaacgtccgtaattaaattttcgttcggtagtataaacagaacgtcgaggccaggtccgaccgtagtcggttcggtctatctatactaaaattagttaacgccgtcctcgacgggtccctagacgacgaatcgtcgtggacgccgaagtcgtacggaccacgnggaccacgctacgaccagtcaggttcgacggaccgtaggcgtaggtaggacgttagggagacgtaagtaccgttaattacgtgtacgacgggtaccggtaggacgtagtacggtcccgtaaggttcggttacgtttacgggtttcggggaacggggtacgggtaaccgtacgggtaccgtaccggtaacccggttaccggtaccggtaccggaccggtaccgaaccgggtccgttacccggcccccgttaccggg

SEQ ID NO: 148184 - DNA, 635 bp, Homo sapiens
  misc_feature: GYAE6OF02GNSWF.10.4.A04.1.454.CMB.1.raw
  modified_base (307)..(307): a, c, t, g, unknown or other
  misc_feature (307)..(307): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactcgtccgtgtcgccaggagagacagccaccattacatcgctctggagaagtcgttgagacgtaattaaatttgtttcggtaggtaataaacagaagtcaggccagtcgcctgtgttgtcatctatactaaaatnttaagccgcctcggacggggtcctaggacgacgtaatcgtcgtcggccgtaccaacggtcgtacgggaacccagacgggaccaccgtacgtacgaaccacgtacgacgtcgtaccgacccgtaggtccgtggtacggagtcggaacggtacgtaacgtacgttaacgttacgtgtacgtacgggtacggtacgggtaacgtaggtacgcgtacgttaggtacgttacgtttccggggacgggtacgggtaaccgaaggtccgtacggtacccgttacgtacggtaccgaaccggtacccgtacggtccgtcccggtacccccgtacgg

SEQ ID NO: 148185 - DNA, 635 bp, Homo sapiens
  misc_feature: GYAE6OF02I6WPN.10.4.A04.1.454.CMB.1.raw
  modified_base (103)..(103): a, c, t, g, unknown or other
  misc_feature (103)..(103): n is a, c, g, or t
  modified_base (110)..(110): a, c, t, g, unknown or other
  misc_feature (110)..(110): n is a, c, g, or t
  modified_base (127)..(127): a, c, t, g, unknown or other
  misc_feature (127)..(127): n is a, c, g, or t
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (424)..(424): a, c, t, g, unknown or other
  misc_feature (424)..(424): n is a, c, g, or t
tcagcatagtagtgcacgaccggtgctcgatttagagtagtgatcaggggctgggcctcaggaagcagcatcggaggtgcctcagccatggcatggatccctntcttccncggcgtccttgcttacngcacngcatccgtgcctcctctgacctgactcagcccaccctnctgtccgtgaccgccaaggaganacagccaacnttacntgcttnggataagcgttagacgtacgaattaagtttgttacgtaggtaataaacagtaancaaggccagtcgctgtgtgcatctaatacgaaaatgtaaagccgaccttacgcgggtcctagacgacgtaatctacgtggaccaccgtaagtccgaggaccaacgacggcaacgctacgacactacgagtcgtacgaccgtagcttaggagtacgngacggtactacgtaaccttagttacctaggtaccggtagggtaccggttaacgggaacgtaacggtaaccggtacggttccgttaagggttagttaaccggttttcgggaccggggtaacgggttaaaccgacggtaccgttaggtaacccggttaccgttacggaccgtacggaacccgacggtacccgttaccggccccgttaaccggg

SEQ ID NO: 148186 - DNA, 637 bp, Homo sapiens
  misc_feature: GYAE6OF02FM4H5.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagcccaccattacatcgctcgtggagaagcgttgagcgtaattaaatttgtttcgtaggtaataaacagaagtcgaggccagtcgcttggtgttggtcatctatacaaaattagtaacgcggtcccgtgtacggggtcctaggacgacgtaactcgtcgtggccgaccgaagttcgtacggaccgaaccgaccggtccctcccgtcgcccgtaaaaaaaacgtcgtcggtcgtccgtacggtcgtggacggagtcggaggtcgttagtacttacgttaccgtcgtcgacgcgtactacttacgttaccgtaccggtacccgtaacggttacgggttcggttacgggtcgggtaccgggtacggtaacggtacggtacccggtccggtcgggtcgaccgaccgtacggccgtcccgtccccggtaccggtccgtaccgtcccgg

SEQ ID NO: 148187 - DNA, 848 bp, Homo sapiens
  misc_feature: GYAE6OF02JW4F1.10.4.A04.1.454.CMB.1.raw
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
tcagcatagtagtgcacgaccggtgctcgatttagagtagtgatcgagggggctgggcctcaggaagcagcatcggaggtgcctcagccatggcatggatccctctcttcctcggctcctgcttacngccacngccactccggtgccctcctctacgaccctgactccgacgccccaccctcacgtcggttcccgtgtcccgcgaagggagtaacgccagcccaacgtacttacgatgcctacgtagggacgagtcggttgaggtaccgtaattaagttgttcgtacggtaataaaccgagaacgttcgaggccacggtccgtccgttggtggttcggtacctgtacttaataaccttaaaagtactttaaacggcccgtaccccgtacggtaccggggtacccgttagaccggtacgtacgttaccgttaccggttccggaaccggccccgttaacgggttaccggtaacggggggtaaccccctaaacccgggtaaccggggaccccttaaacggtcccggaaccgtacccgtaaccgtaccggtaaccgggttacggaccgtaccccgggtacggtcgggtaaccgggtcggttacggacggacgggtaaccgtacggtaaacgtttacgtaccgttacggtacgggtccgggtacggtcgggtaaacgtaacggtcgggtacccgtagtttcggaacgggttccgggttttaccgggaggggtaaccggtacccgggttaacggtacccgggtacgggtacccggggttaccgtttaacccggggaccgttaccggaccccggtacggtaccccggttccccgggtacccccgttacccccggg

SEQ ID NO: 148188 - DNA, 694 bp, Homo sapiens
  misc_feature: GYAE6OF02J04X4.10.4.A04.1.454.CMB.1.raw
tcagcatagtagtgcacgaccggtgctcgatttagagtagtgatcaggggctgggcctcaggaagcagcatcgggaggtgcctcagccatggcatggatccctctcttcctcggcgtccttgcttactgcacagcatccgtggcctcctctgacctgactcacgccaccctcactgtccgtgtccgccgaggagaggacacgaccaccattacatcgctcgtggtaaggaacgcggttagacggacgtaattaaacgttttggttacggtaggtaataaacgacgtagtcgacggacctaggtccgtccgttgtgttcggtactatcgtaataacgtaaattagttaacggccggcccgttacggacggggttaccctaggtacgacgtaacgtccgtacgcgggtaccgaccgtaacggtcggtacgggacctacgacgggactaccggactacggacctcgtacgtacggtacggttacggacccgtaggtccgttaggggtacgtaggtacggacggtacgtaaagtaccgttaagttaccggtacggttacggcgggtacggtacgggtaaccgaggtccgtacggttgttacggtgttacggttcgggacggacggtaaccggtcgtacgttcggtaccggttacgtacggtcgaccggtaccgtacggcccgtaccggtccccgtcgg

SEQ ID NO: 148189 - DNA, 686 bp, Homo sapiens
  misc_feature: GYAE6OF02IJETO.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtcgccaggagagacacgccaccattaccatgctcgtaggagaagtcgttagagacgtaatttaaattttgtttcgtaggtaataaaacgagaagtcgacggacctaggtccgtcctggttggtttcggtctatcttaataactaaaattagttaaacggcccggtacccttacggtaccgggggttccctagggaacggacgtaacgttccgttcgtcgggccgtacccgtaaaggttccgtacggggaacccacgaacgggccctaacggctacgacctacgtacgtaggttacgtacgaacccgtaggcgttggtaggagtaggacgtacgaacgtacttacgttacgtggtacgaggggtcggtacgggacgtagggtacggccgtaggtcggttacggttacggtttcggggacgggtacgggaaccgtaacggtccgtacggtacccggttacgtacgggtccaccggtacccgacggtcccgttcccggccccgtccgg

SEQ ID NO: 148190 - DNA, 731 bp, Homo sapiens
  misc_feature: GYAE6OF02H9RWJ.10.4.A04.1.454.CMB.1.raw
  modified_base (103)..(103): a, c, t, g, unknown or other
  misc_feature (103)..(103): n is a, c, g, or t
  modified_base (181)..(181): a, c, t, g, unknown or other
  misc_feature (181)..(181): n is a, c, g, or t
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
tcagcatagtagtgcacgaccggtgctcgatttagagtagtgatcaggggctgggcctcaggaagcagcatcggaggtgcctcagccatggcatggatccctntccttcctcggcgtccttgcctttactgcacagcatcccgtggccctcctctgacccttgacctcacgcccacccctnacttcgtccgtgtccgccgaggagacgaccacgccacctattaccatgacctcgtagggagagtcgttagagaccgtaattaaagttttggtttacggttaggttaacgtaaaacctaaggaacgttaccgacggtccacggttccgaccttggttgtttcgggtctaataccgttaataacctaaaaatcgtttaaacgccggtccctacggtacggggtaccctggacgacgtaatcgtcgtcgccgtacacgtcggtacggaaccacgacggccacgtccgtacgaccatccgaggttcgccgtacccgnggtccgtagtgggtagnggtacgacgaagtaccttagttacgtacggtacggtacgggtacggacgggtaacgtagggttaccgcggttccgtagggttcggtttaacggttttccgggacggggtaaccggaacggtcgtaccggtaccgggttaaccccggtttaccgtaccggttaccgacccggttaccccggtaacggtcccgttccccccggtacccccgtttaccccggg

SEQ ID NO: 148191 - DNA, 600 bp, Homo sapiens
  misc_feature: GYAE6OF02IOOF3.10.4.A04.1.454.CMB.1.raw
  modified_base (196)..(196): a, c, t, g, unknown or other
  misc_feature (196)..(196): n is a, c, g, or t
tcagcatagtagtgcacgaccggtgctcgatttagagtagtgatcagggggctggggcctcaggaagcagcatcgggaggtgcctcagccatggcatggatcccctctcttcctcggcgtccttgcttactgcacagcatccgtggccctcctctgacctgacctcagcccaccctcactgtccgtgtcgccaggngagacagccaccattacatgctcgtggagaagcgttgagcgaattaatttgttcgtggtaataaacagaagtcgaggccagtcgctgtgttggtcatctatactaaaattagttaagccgtacctcgacgggggtcctggacgcgaatcgtcgtcggccgacctaggtcgtcgggaacccacgacggcacggctacgacctatcgaggttggcgacccgaggtcgtgggtggacgtggacggacacggtaacttacgttactggtacgagggtcggtaggggacgtaggtacgtcgtcgttggaggttacgtttcgggacggggaacgggtaccgaaggtccgtacggtaccgttaccgtagggtccaccggccgaacgggtccctacccggtccccgttccgg

SEQ ID NO: 148192 - DNA, 778 bp, Homo sapiens
  misc_feature: GYAE6OF02HAHHV.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagcccaccctcactgtccgtgtcgccaggagagacagcccaccattacatcgctcgtaggagaacgtcgttagagtacgtaattaaagttttgtttacggtagggttaaactaaaaccgtagtaaaggtccgaagggtcccaaggtccgtcccttggttggtttcgggtctaacttccgtaagtactaaaaatagtttaaacggccggtaccccttacggacgggggttcccctaggacgtacggtaacttccgtcgtcggaccgtacccgtaacggttccggtacggggaacccaaccgtaacgggaccgaccggtacccgtacgtaacccgtactaccgtacggttaggtacccggtaaccccgtacgggttccggtcggtacgggtaaggtcgggaacgggtaccgtaacgggttaacttaacgtttaaccgtacggtacggtaacgggtcgggtacgggtaaccgtagggttaaccgggcggttaccgttggttaccgttacggttttaccggggacgggtaacgggacccgtaacggtccggtacggtacccggttaccggtacgtacgtaccgggtacccgaacgggtcccgtccggtcccccgtacccggg

SEQ ID NO: 148193 - DNA, 754 bp, Homo sapiens
  misc_feature: GYAE6OF02G1PJD.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcacgcccaccctcactgtcccgtgtccgccaggagacgacacgcccaacctattaccattcgccttcgtggagtaagtcgttagagcgtaattaaattttggtttacgtcggtaattaaacgagaacgtcacggccgagtaccgcctggtggttgggtctagttctaatactaaaaattagttaacgccggtccctacgacgggggttccctaggagtacgtaagtcctacgtcggacgccgtaaggtccgtaggggacccacgacggacctaccggctacgaccacgtcgaggtcgtacggaaccctaggctacgggtagggacgtggaaccgggtcgaaacgggttaactttaacgtttacggtacggtccggtacggggaccgggttaggggaacccgtaggggttaaccggccggtacggttttcggttacggtttaaggttttcccgggggacggggttaaccgggggaaaccgtaagggttcccggtacgggtaacccccgggttacccgtttaaggggtaccccgtaaccggggtaccccggtaaaccggggtcccccgttacccggggtaccccccgttacccgggg

SEQ ID NO: 148194 - DNA, 783 bp, Homo sapiens
  misc_feature: GYAE6OF02IFI9I.10.4.A04.1.454.CMB.1.raw
  modified_base (103)..(103): a, c, t, g, unknown or other
  misc_feature (103)..(103): n is a, c, g, or t
  modified_base (126)..(126): a, c, t, g, unknown or other
  misc_feature (126)..(126): n is a, c, g, or t
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
tcagcatagtagtgcacgaccggtgctcgatttagagtagtgatcaggggctgggcctcaggaagcagcatcggaggtgcctcagccatggcatggatccctntcttcctcggctccttgcttacngcacagcatccgtggcctccgtctgacctgactcagcccaacctnactgtccgtgtccgcagganagacagtccactagttacntgactcgaggagtacgtggttcgaagtacgtaatttaaaagtttttcggtttacggttaggttaaacttaaaaccgaggtaaacgttcgaacgggacctaaggttccggccgttgggtcggtttcggttaccgtattaaccttataaaccgtaaaatttaagtttaaacggcccgggtaccccttacgggaaccgggggttcccgtaggaaccggaccggtaaacttcgtccgtacgggaccgtaccgtaaacggttcggtacggggaacccaccgtaacgggccctaacgtccgtacgtaacccgacgtaacgtaggtacgttacggacccgtacggtcgttacggtacgggtagtacgggaacggtcgtaaaggtacgtttaacgttacccgtaaggttcggtaaccggggacgggttaccggggaacgtacggtaacgggtccgtcggtacggttcgttaacgggttttcgggacgggtacgggtaaccgaacggtccggtacggtacccggttaccgtacggttccgacggacccggtaaccggtccgttcccgccccggttaacccgg

SEQ ID NO: 148195 - DNA, 776 bp, Homo sapiens
  misc_feature: GYAE6OF02I7Z56.10.4.A04.1.454.CMB.1.raw
  modified_base (83)..(83): a, c, t, g, unknown or other
  misc_feature (83)..(83): n is a, c, g, or t
  modified_base (132)..(132): a, c, t, g, unknown or other
  misc_feature (132)..(132): n is a, c, g, or t
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
  modified_base (177)..(177): a, c, t, g, unknown or other
  misc_feature (177)..(177): n is a, c, g, or t
  modified_base (555)..(555): a, c, t, g, unknown or other
  misc_feature (555)..(555): n is a, c, g, or t
tcagcatagtagtgcacgaccggtgctcgatttagagtagtgatcaggggctgggcctcaggaagcagcatcggaggtgcctnagccatggcatggatccctctcttcctcggcgtccttgcttactgcacngcatccgtgcctcctntgactgactcagccacctnactgtccgtntcgccgaggagagacagaccacattacattcgctcgtggaacgagtcgtagagacgtaattaaacgttttgttcggtaggtaactaaacgagtaacgtcgaggtaccgaggtccgtccgtggttggtttacggtactagttacctaattaacgaaaaatttacggttaaacggcccgggtaccctaccggtaacgggggttacccgtaggaacggtaccgtaaacttccgttacggcggaccggtaacctaacgggtttaccgacgggaaccaacggtacgggacacggtacctacgacctaagtacctaaggtacggtaccgaacccgtaggcgttaggtaggtacgtagggaacggactaagtaccttagttacgnggtacgagggtacggtacgggaatacggtacggtcgttacggtacggttaacgttacgggtttaccggggacggggttaaccgggtaacccgtaacggggttaccggttaccggggtaaaccccggtttaccggttaaccgggttacccgggaacccgggtaaaccccggttaacggggtaccccgttaccccccggggtaccccccggtttaaccccggg

SEQ ID NO: 148196 - DNA, 831 bp, Homo sapiens
  misc_feature: GYAE6OF02HRN24.10.4.A04.1.454.CMB.1.raw
  modified_base (169)..(169): a, c, t, g, unknown or other
  misc_feature (169)..(169): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtgcctcctctgacctgactcagccaccctnactgtccgtgtcgaccgaggtacgacgacctagcccaactattacagttgccttgagggacaaggtccgtttggaacggtacgtaatttaaaagtttggttttaccggtaggttaaactaaaacgaggtaaacgttccgaagggtccctaaggttcccgtcccgtttaggttcggtttacgggttacctacggtttacctaattaaaccgtaaaaattacgtttaaacggcccggtacccttacggtaccggggtcctagacgccgtaacgtctcggtcggcgtaccgaaggtcgtaggaaccacgtacgggctaccggctacgaacctacgtacgtaggtcgtacgaacccgtcgggtacgtcgggttacgtaggtaccgggaggtaccgtaacggtaaccgtttaacgtttaccggttacggtaaccggtaacggggtaccgggttacggggtaaacgtacgggttacgggacccgttccggttacggttacgggtttaaccggttttccgggggaccgggttaaccgggttaacccgaaacggggttcccggttaaccgggtacccccggtttaaccggttaacgggggttcccaacccggggacccccggttaaacgggtccccgggtttaccccggtcccccccggtttaacccggg

SEQ ID NO: 148197 - DNA, 792 bp, Homo sapiens
  misc_feature: GYAE6OF02H8Z1L.10.4.A04.1.454.CMB.1.raw
  modified_base (245)..(245): a, c, t, g, unknown or other
  misc_feature (245)..(245): n is a, c, g, or t
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgacctcagcccaccctcacgtgtccgtgtaccgccaagggacacgaccacggaccctaaccatttaaccattcggccttcgtaggggaanaacggtcggttggaacgtaccggtaatttaaagttttggtttaccgtagggttaactaaacgagaacgtacgacggacctacggtccgtccgttggttacggtttcggtacctacgttaccttaacttaacgtaaaaactttacgttaaaccgggtcccggtaccccgttacggtaccgggggttaccccgtaggtaccggaaccggtaacttccgttccgggtacggacccgtacccgtaaacggttccggttaccggggaaccctaacgaaccgggccgtaaccggtccgtaaccggacccgtagtacgtacgttcggaccgaaccgtaggtcgtacgggtggtaacgtggacggactaacgttacgttacgttaccgtgtacccggtaagggtaccggttacgggaacgtaggttacggtccgtacggttaaggttcggttacggtttaccggggacgggtaccgggaactaacggtccggttaacgtacccggtacgttaggtccgaacggacccgtaacggtcccgtccccggacccgtcgg

SEQ ID NO: 148198 - DNA, 845 bp, Homo sapiens
  misc_feature: GYAE6OF02GP35W.10.4.A04.1.454.CMB.1.raw
  modified_base (110)..(110): a, c, t, g, unknown or other
  misc_feature (110)..(110): n is a, c, g, or t
tcagcatagtagtgcacgaccggtgctcgatttagagtagtgatcaggggctgggcctcaggaagcagcatcggaggtgcctcagccatggcatggatccctctcttccncggctccttgcttactgcacagcatccgtggccctcctctgacctgactcacgcccaccctcactcgtcccgtgtccgccagggacgagaccacgccctaaccctatttaaccagttccgccttaccgtaggggaacgtaacggtccggtttaggaacggtacgtaaatttaaacgtttttggtttaccggtagggttaaataaaaccgaggtaaacgttcgaacgggtaccgtacggttaccgtcccgtttggttaggtttcgggtactaagttccttaataacctaaaaagtttacgtttaaaacggcccggtaccccgttaccgggtacggggttccccgtaggaccggtaccgttaaacgttcccgttacggtccggggtacccgtacccggtaacggttccggttacccggggaaccgaaccggtacgggaccgtacccgggacccgtacggtaacctaacgtccggtacggtaccggtaccggaaccccggagggtccggtaggttcggggaacgttacggaacggtacctaaacggttaccttaacgttaccgtacggttaccggacggggtcggttaaccggggactacgggtaacgcggttcgttaggtaccggttacgtttcggggacggtaacgggaccgtaacggtccggtaccggtaccggtaccggtacggtaccgaccggtaccccgtaacgggtccctaccccggtaccccgttaccgg

SEQ ID NO: 148199 - DNA, 823 bp, Homo sapiens
  misc_feature: GYAE6OF02J0TH2.10.4.A04.1.454.CMB.1.raw
  modified_base (90)..(90): a, c, t, g, unknown or other
  misc_feature (90)..(90): n is a, c, g, or t
  modified_base (162)..(162): a, c, t, g, unknown or other
  misc_feature (162)..(162): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (589)..(589): a, c, t, g, unknown or other
  misc_feature (589)..(589): n is a, c, g, or t
tcagcatagtagtgcacgaccggtgctcgatttagagtagtgatcaggggctgggcctcaggaagcagcatcggaggtgcctcagccagnggcatggactccctctccttcctcggcgtccttgcttacgtgcacagcatccgtggcctcctctacgtaccngacctcacgcccacctcacttcgtccgtcgtcgaccgagggacgacgacgaccgaccgtaacctaatttacacttcgcctcgtaggtaggtaacggtccggtttagacggtaccgttaaagttttaacgttttggtttacggtaaggtttaacaaaggtacggtaaagtaccgtcgggtacccgtaagggttcccgtaccgtttgggtaccggtttaggtacccgtaaatttggtaaacgttaaaacctttaaaaagttaccgttaaccgggtacccgggttaccccgttaacggggttaccgggttccccgtaaaggtacgttaaccggtacttcggtccgttaccggacccggtacgtacgtacggtacgggactacgacggccncgtaacnccgactctacgtactcggtaccgaccgtacggngttaggacgttaggcggaggtaactacggttaaaccttagtacgttcggtacgggtcgggtaccggtacgggtacgtaacggttacgtaccgttcggtaacgggttcgttaacgggtttacccggggagggtaacccggtaacggaccggttaccgtacccgggtaaccgttaccggtaccggtacgtaccgggtaccggtaacccgtccggttacccccgccggttaccccgg

SEQ ID NO: 148200 - DNA, 786 bp, Homo sapiens
  misc_feature: GYAE6OF02GXBW4.10.4.A04.1.454.CMB.1.raw
  modified_base (112)..(112): a, c, t, g, unknown or other
  misc_feature (112)..(112): n is a, c, g, or t
tcagcatagtagtgcacgaccggtgctcgatttagagtagtgatcgaggggctgggcctcaggaagcagcatcggaggtgcctcagccatggcatggactccctctcttccncggcgtccttgcttactgcacagcagtccgtggcctcctctgacctgactcacgcccaccctcacgtgtccgtgtccgccgagggagacgaccacgacccaacctatttaaccagttcgcctcggtagggaacgtaacggtccggttaggacgacgtaatttaaagttttggtttacggttaggttaacttaaaaacgaggtaaacggttccgaaggtcccgtaacggttcccggtcccgtttagggtttacgggtttcgggttacctaacgttccgttaaacgttaaacctaaaagtttaacggtttaaccgggcccggttaccccgttaccgggtaccgggggtttacccctagggacggtaccgtaaacgttccgtacggtcgggaccgtaccgtaaacggtttcggtacgggtaaccacggacgggccacgtccgtacgaccgtactcgtaggtcgtacccggaccgtacggtcgttagggtacggtacgtgggacgtacgtaacgtacctttattaccgtggtacggtacgggtacggtacggacgtaggtaggtaccgtcgttaggtacggttacggtttcggggacgggtaacggtaccgtacgtacggttaccggtccgtaacgttcgtacgaccggtaccgaggtcccgtcccggtccgtaccgg

SEQ ID NO: 148201 - DNA, 730 bp, Homo sapiens
  misc_feature: GYAE6OF02IWT53.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggccctcctctgacctgactcacgcccaccctcactgtccgtgtccgaccgaggacgagaccagcccaccattacatcgctcgtaggaagagcgttagacgacgtaattaaagttttggtttacggtaggtaaactaaaacgaggaagttcgaggtccaggtccgtccgttgggtcgtttggtactattcgtaactaactaaaaagtttacgttaacggcccggtccccttacgggaccgggggttacctcgggacgtacggtaacttccgtacccgtgggaccgtaaccgtaacggtccgtacgggaaccctaaggaccggcctaaccggcgtaccgaaccgtactacgtacgggttacgtaccggacccggtaggtcgttgggtacggtagttcgggaacgtcgtaagtacctttagttcgtcgggtagtagggtaggtaccgggaatagggtacgcgttacggttggttcgtttaaccgggtttcgggacggggtacggtaccgtaacggtccggtaaccggtaccgttacccggtagtcccggaaccggtaccgaccgggtccctaccccgggtccccgttaccgg

SEQ ID NO: 148202 - DNA, 698 bp, Homo sapiens
  misc_feature: GYAE6OF02HHO5V.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcacgccaccctcactgtccgtgtcgccaggagagacagccacattacatggctacgtggagagtcgttagagacgtaatttaaagttttggtttacgttaggttaaataaacgtaggtaacgtacgtacggccgtacggttccgtccgttagggttcggttcggttctaagttactaactaactaaaaacgttacgttaacggcccgggtcccctaacgggtaccggggttaccctaggacgtaccgtaacgttcctcggtcggacccacgtaacggtccgtacgggacctaccgacggtaccgacggtctacggaacctcgtacgacggttcgtacggacccgtagggtcctggtacggactggaacgactagtacttatacgtgtcgagggtacggtcgggtaactaggtacgtcgtcttaggttcgtacgggtttcgggaccgggtacggacggtcgtaccggttaccggtacccgtacggtaaccggcgtaacccggtaccggtccggttacccgtccccggttccccgtaccgg

SEQ ID NO: 148203 - DNA, 776 bp, Homo sapiens
  misc_feature: GYAE6OF02GD6YF.10.4.A04.1.454.CMB.1.raw
tcagcatagtagtgcacgaccggtgctcgatttagagtagtgatcaggggctgggcctcaggaagcagcatcggaggtgcctcagccatggcatggatccctctcttcctcggcgtccttgcttactgcacagcatccggtggcctcctctgacctgactcagcccacctcactgtccgtgtcgccaggagagacacgccacattacagtcgctcgtggaacgaagtcgttagacgtcgtaattaaagtttgtttcgtaggtaactaaacagtaagtcacggtcctagtccgccgttaggtgtttcggtcctataccgttaataactaaaaagttacgttaaacggccggtaccccgttacggaccgggggttcccctggtaaacggtccggtaaacgttcgtcggttacggaccgtaccgtaacgggttaccgttacggggaacccaacggaccgggtaccgtacccgtaccgtacgaaccctaagttaccgtagggttacggtacccggaaccccggtacggggtaccgttcgggtacggtacggtacggaacgggtacctaacggtaacctttaacggtttacgtacgggtaccggtacgggttacgggtaccgggtaaacgacgggttaaggtccgtacggttgtacggtttacggtttacgggtacgggtaacgggaaccgtaaccggttcgtacccgggtacccgttacggttaacgggtccgtaaccggtacccgtaacgggcccgttaccccgtccccggttacccgg

SEQ ID NO: 148204 - DNA, 774 bp, Homo sapiens
  misc_feature: GYAE6OF02HJR9H.10.4.A04.1.454.CMB.1.raw
tcagcatagtagtgcacgaccggtgctcgatttagagtagtgatcagggggctgggcctcaggaagcagcatcgggaggtgcctcagccatggcatggactccctctcttccgtcggcgtccttgccttactgcacaagcacgtccggtggccctcctctcgtacctgacctcgacgccctaccctcgacttcggtaccgtgtcccggaccgaagggagacgaacacgacccgaacctattaccatcggtacctcggaggaacgtacggtgttagagtacgtaattaagttttcggttacgttaacggtaataaacgaggtaacgtacgacggtacgtaacgtccggtccgtggttcggttacggtactacgttactaactaaccgtaaaaattacggttaaacggccggtaccccgttaacgggaccgggggttaccctcggaacggtaccgtaacgtccgttcggtaccggacccgtacgtaacggttcccggtaacgggaaccctaggacggtaccaaccggtgtaccgaaccgtacgtcgtaaccggtcgaccggaccgtcgggtacgtcgggtagagtaggcggtacgaacgttactagtacggttacggtacggacggtacggtacggacgtacggtacgcggttacggtcgttacgggttaccgttacgggaccgggtacggtaaccgtacggtccgtacggtacccggtacgtagcccggtaccgtaacccggtacggtacccggtacccgtaccccggttaccgg

SEQ ID NO: 148205 - DNA, 777 bp, Homo sapiens
  misc_feature: GYAE6OF02HWTWF.10.4.A04.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagcatagtagtgcacgaccggtgctcgatttagagtagtgatcgaggggctgggcctcaggaagcagcatcgggaggtgcctcgacgccagtggcatgggactccctctcttcctcggcgtccttgcttatgcacagcactccgtcgccctcctcgtcgacctgacctcgacgcccaccctctacgtcgtcgtcgccgcgaggagacgacacgccactattacngtgcgtcgtaggaggtacncggttagagtacgtaagttaagttttcggttacggtaggtaaactaaacgtaacggtacggtacgacggtcctacggtcccgtagtttacgggttcgttcggtactaacgttacgttaacttaaacgaaagtttaacggtaccggtacccgtccggtacggtacccgggttacgtcggtaacgtacgtacgttcgtcggtacggtacggtaaccgtacggtaccggtaccggaaccgacggtaccggaccgtacggtaccgtacggtaactacgtacgtaccggttaacggtaccggtaacccggtagttacggtcgggtaacggtacggtaacgacggtaacgtaacgttaacgttaacgtttaccggtaacggtacgggttaggtacccggggttaggtaccgttaacggtacccgggttagtaacggtttaccggtggttaaccggttcgggacggtacggacgtacgtccggttaccgaccgtacgtaccgaccggtaccggaccgtcggtccgtccgtcccggtacg

SEQ ID NO: 148206 - DNA, 676 bp, Homo sapiens
  misc_feature: GYAE6OF02GDUEV.10.4.A04.1.454.CMB.1.raw
  modified_base (449)..(449): a, c, t, g, unknown or other
  misc_feature (449)..(449): n is a, c, g, or t
tcagcatagtagtgcacgaccggtgctcgatttagagtagtgatcaggggctgggcctcaggaagcagcatcggaggtgcctcagccatggcatggactccctcttcttcctcggcgtccttgcttactgcacagcatccgtgcctcctctgacctgactcagcccaccctcactcgtccgtgtccgacgagggagagacacgacccaacctattacatcgctcgtaggagaagcgttagacgtacgtaatttaagtttggtttacgtaggtaataacgagaagtcgaggtcgtacgtcgtcgttggtggttgtactatactataactaaatacttacggccgtacccgtacgtacggggtcctaggacgtacgtaactccgtcggtcggacgaccgtaaggtccggacggtacccacggaacggcctaccgcgtacgaacctgtacgnggtacgtcgaacccggtgtcgtaggtacgagtggacggacgtagttaacttacggtacgttacggtaccggaggggtacggttaacggaacgtacggttacggccgtagttcgggttacgtttaacgggttcggggacgggaacggtacctaacggtccgtacggtaccccggttagtacgggtaccaccgggtaacccgacgggtcccgtccggtacccgtaccgg

SEQ ID NO: 148207 - DNA, 943 bp, Homo sapiens
  misc_feature: GYAE6OF02G9EN6.10.4.A04.1.454.CMB.1.raw
tcagcatagtagtgcacgaccggtgctcgatttagagtagtgatcgaggggctgggcctcaggaagcagcatcggaggtgcctcagccatggcatggactccctctcttcctcggctccttgcttactgcacagctacttccggtcgtccctcctcgtcgacctgacctcacgccctaccctcaccgtcgtccgtgtccgaccgaggacgacgaccacgtacccaacctattacctagtcggtccttcgagggaacggtaaggtcgttaggaagtacggtaattttaaacgtttttcggtttaggtacgttaaactaaacgtaggtaaacgtccggaacggcccgtacggtcccggtccgtttgggttcggtttacggacttacgttacttaattaaacgttaaaacttacggttaaccggcccggtacccgtaccgggtaccggggttccctaggtaaccgtcgtaacgtcgtcggtccggacctacgtaccggttcggaaccgggtaaccaacggaccggtacccgacccggtttaccgaccgtaaacccttcggttaaccgttaccggggttaacccggtcccgggtaaacccggggttagggtccgggtagggtaggtacggtaccgggtacggtaaccgttaacgtttaccggtttatacccggttacgggtacggtaccgggggtttacgacggggggttaaccgtacgggttccggtacgggtttaccggtttcggttaacgggggtttttaacccggttacgggggggtacccgggaaacgggttttaccccgggtaaccggttaccccggggtttaaccgggtttaacccccggttaccgggggttttaacccggaccccgggttaacccccggtaacccggtttaccggggggtttacccccctcccccggggtttacccccggttaccccgg

SEQ ID NO: 148208 - DNA, 249 bp, Homo sapiens
  misc_feature: GYAE6OF01EK7W4.24.21.B10.1.454.CMB.1.raw
  modified_base (232)..(249): a, c, t, g, unknown or other
  misc_feature (232)..(249): n is a, c, g, or t
tcagactactatgtcacgaccggtgctcgatttagtgtcgtcgcaagaggagagggggtcaggctggaagctgaggatgtcgcagtttattactgcacacaatctacacaatttccgtacacttttggccaggggaccaagctggagatcaaacgaactgtggctgcaccatctgtcttcatcttccgccatctgaacatagtagtctgagcgggctggcaaggcgcatagnnnnnnnnnnnnnnnnnn

SEQ ID NO: 148209 - DNA, 334 bp, Homo sapiens
  misc_feature: GYAE6OF01BE68K.24.21.B10.1.454.CMB.1.raw
  modified_base (154)..(154): a, c, t, g, unknown or other
  misc_feature (154)..(154): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (262)..(272): a, c, t, g, unknown or other
  misc_feature (262)..(272): n is a, c, g, or t
  modified_base (274)..(274): a, c, t, g, unknown or other
  misc_feature (274)..(274): n is a, c, g, or t
  modified_base (276)..(334): a, c, t, g, unknown or other
  misc_feature (276)..(334): n is a, c, g, or t
tcagactactatgtcacgaccggtgctcgatttagtgtcgtcgcaagagggagagggggtcaggctggaagctgaggatgtcgcagtttattactgcacgaccaatctacacaattttcccgtacgacttttggccagggggaccaagctgganactcaaacgaactgtggctgcaccatctgtcttcattccttcccgccactctgaacatagtagtctggagcgggctgggaccaaggcgctagttaggcnantgcanannnnnnnnnnnanannnnnnnnnnnnnnnnnnnnnnnnnnnnnnnnnnnnnnnnnnnnnnnnnnnnnnnnnnn

SEQ ID NO: 148210 - DNA, 157 bp, Homo sapiens
  misc_feature: GYAE6OF01ESW61.51.15.B04.1.454.CMB.1.raw
  modified_base (157)..(157): a, c, t, g, unknown or other
  misc_feature (157)..(157): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagn

SEQ ID NO: 148211 - DNA, 160 bp, Homo sapiens
  misc_feature: GYAE6OF01BOKI4.51.15.B04.1.454.CMB.1.raw
  modified_base (157)..(160): a, c, t, g, unknown or other
  misc_feature (157)..(160): n is a, c, g, or t
tcagcgatcgtatacacgaccggtgctcgatttagacagtatatatccggcgggcacgaccggtgctcgatttagagtgctacgaagggaaagggcagcgtcactctgttcccgcctcctctcgtagcactctgagcgggctggcaaggcgcatagnnnn

SEQ ID NO: 148212 - DNA, 159 bp, Homo sapiens
  misc_feature: GYAE6OF01BU3GH.51.15.B04.1.454.CMB.1.raw
  modified_base (157)..(159): a, c, t, g, unknown or other
  misc_feature (157)..(159): n is a, c, g, or t
tcagcgatcgtatacacgaccggtgctcgatttagacagtatatatccgcgggcacgaccggtgctcgatttagacacatacgcagggaaagggcagcgtcactctgttcccgccctcctctcgtagcactctgagcgggctggcaaggcgcatagnnn

SEQ ID NO: 148213 - DNA, 157 bp, Homo sapiens
  misc_feature: GYAE6OF01CNI8O.51.15.B04.1.454.CMB.1.raw
  modified_base (156)..(157): a, c, t, g, unknown or other
  misc_feature (156)..(157): n is a, c, g, or t
tcagcgatcgtatacacgaccggtgctcgatttagacagtatatatccgcggtcacgaccggtgctcgatttagagtgctacgaagggaaaggcagcgtcactctgttcccaccctcctctcgtagcactctgagcgggctggcaaggcgcatagnn

SEQ ID NO: 148214 - DNA, 196 bp, Homo sapiens
  misc_feature: GYAE6OF01AGZYO.51.15.B04.1.454.CMB.1.raw
  modified_base (195)..(196): a, c, t, g, unknown or other
  misc_feature (195)..(196): n is a, c, g, or t
tcagcgatcgtatacacgaccggtgctcgatttagacagtatatatccgcgggcacgaccggtgctcgatttagacagtatatatccgcgggcacgaccggtgctcgatttagagtgctacgaaggaaagggcagcgtcactctgttcccaccctcctctcgtagcactctgagcgggctggcaaggcgcatagnn

SEQ ID NO: 148215 - DNA, 158 bp, Homo sapiens
  misc_feature: GYAE6OF01B69TW.51.15.B04.1.454.CMB.1.raw
  modified_base (157)..(158): a, c, t, g, unknown or other
  misc_feature (157)..(158): n is a, c, g, or t
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnn

SEQ ID NO: 148216 - DNA, 192 bp, Homo sapiens
  misc_feature: GYAE6OF01DX3OT.51.15.B04.1.454.CMB.1.raw
  modified_base (192)..(192): a, c, t, g, unknown or other
  misc_feature (192)..(192): n is a, c, g, or t
tcagcgatcgtatacacgaccggtgctcgatttagacagtatatatccgcgggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagn

SEQ ID NO: 148217 - DNA, 247 bp, Homo sapiens
  misc_feature: GYAE6OF01EAOTM.51.15.B04.1.454.CMB.1.raw
  modified_base (207)..(208): a, c, t, g, unknown or other
  misc_feature (207)..(208): n is a, c, g, or t
  modified_base (210)..(247): a, c, t, g, unknown or other
  misc_feature (210)..(247): n is a, c, g, or t
tcagcgatcgtatacacgaccggtgctcgatttagacagtatatatccgcgggcacgaccggtgctcgatttagacagtatatatcgcgggcacgaccggtgctcgatttagacagtatagtatccggcgggctggcaaggcgcatagctgcctggtcaaggactacttcctcgtagcactctgagcgggctggcaaggcgcatagnncnnnnnnnnnnnnnnnnnnnnnnnnnnnnnnnnnnnnnn

SEQ ID NO: 148218 - DNA, 158 bp, Homo sapiens
  misc_feature: GYAE6OF01AX108.51.15.B04.1.454.CMB.1.raw
  modified_base (158)..(158): a, c, t, g, unknown or other
  misc_feature (158)..(158): n is a, c, g, or t
tcagcgatcgtatacacgaccggtgctcgatttagacagtatatatccgcgggcacgaccggtgctcgatttagctgtgcgtcgaagggaaagggcagcgtcactctgttcccaccctcctctcgtagcactctgagcgggctggcaaggcgcatagn

SEQ ID NO: 148219 - DNA, 259 bp, Homo sapiens
  misc_feature: GYAE6OF01ADUJ3.51.15.B04.1.454.CMB.1.raw
  modified_base (195)..(195): a, c, t, g, unknown or other
  misc_feature (195)..(195): n is a, c, g, or t
  modified_base (198)..(259): a, c, t, g, unknown or other
  misc_feature (198)..(259): n is a, c, g, or t
tcagcgatcgtatacacgaccggtgctcgatttagacagtatatagtccgggcgggcacgaccggtgactcgatttagctctacgctcagggcacgaccggtgctcgatttagagtgtctacgaaggaaggcagcgtcactctgttcccgaccctcctctcgtagcactctgagcgggctggcaaggcgcatagnagnnnnnnnnnnnnnnnnnnnnnnnnnnnnnnnnnnnnnnnnnnnnnnnnnnnnnnnnnnnnnn

SEQ ID NO: 148220 - DNA, 158 bp, Homo sapiens; identical to SEQ ID NO: 148215
  misc_feature: GYAE6OF01AYVWU.51.15.B04.1.454.CMB.1.raw
  modified_base (157)..(158): a, c, t, g, unknown or other
  misc_feature (157)..(158): n is a, c, g, or t

SEQ ID NO: 148221 - DNA, 264 bp, Homo sapiens
  misc_feature: GYAE6OF01CUXC2.51.15.B04.1.454.CMB.1.raw
  modified_base (262)..(264): a, c, t, g, unknown or other
  misc_feature (262)..(264): n is a, c, g, or t
tcagcgatcgtatacacgaccggtgctcgatttagacagtatatatccgcgggcacgaccggtgctcgatttagacagtatatatccgcggcactaccggtgctcgatttagctctacgctcagggcacgaccggtgctcgatttagctctacgctcagggcacgaccggtgctcgatttagagtgctacgaagggaaaggcagcgtcactctgttcccgcctcctctcgtgcactctgagcgggctggcaaggcgcatagnnn

SEQ ID NO: 148222 - DNA, 157 bp, Homo sapiens; identical to SEQ ID NO: 148210
  misc_feature: GYAE6OF01DN948.51.15.B04.1.454.CMB.1.raw
  modified_base (157)..(157): a, c, t, g, unknown or other
  misc_feature (157)..(157): n is a, c, g, or t

SEQ ID NO: 148223 - DNA, 196 bp, Homo sapiens
  misc_feature: GYAE6OF01EX92Z.51.15.B04.1.454.CMB.1.raw
  modified_base (196)..(196): a, c, t, g, unknown or other
  misc_feature (196)..(196): n is a, c, g, or t
tcagcgatcgtatacacgaccggtgctcgatttagacagtatatatccgcgggcacgaccggtgctcgatttagtgtgagtagttccgcgggcacgaccggtgctcgatttagagtgctacgaagggaaagggcagcgtcactctgttcccaccctcctctcgtagcactctgagcgggctggcaaggcgcatagn

SEQ ID NO: 148224 - DNA, 155 bp, Homo sapiens
  misc_feature: GYAE6OF01C8YDC.51.15.B04.1.454.CMB.1.raw
  modified_base (155)..(155): a, c, t, g, unknown or other
  misc_feature (155)..(155): n is a, c, g, or t
tcagcgatcgtatacacgaccggtgctcgatttagacagtatatatccgcgggcacgaccggtgctcgatttagagtgctacgaagggaaaggcagcgtcactctgttcccacctcctctcgtagcactctgagcgggctggcaaggcgcatagn

SEQ ID NO: 148225 - DNA, 165 bp, Homo sapiens
  misc_feature: GYAE6OF01EY6BN.51.15.B04.1.454.CMB.1.raw
  modified_base (158)..(165): a, c, t, g, unknown or other
  misc_feature (158)..(165): n is a, c, g, or t
tcagcgatcgtatacacgaccggtgctcgatttagacagtatatatccgcgggcacgaccggtgctcgatttagtcacgcgagaaagggaaagggcagcgtcactctgttcccgccctcctctcgtagcactctgagcgggctggcaaggcgcatagnnnnnnnn

SEQ ID NO: 148226 - DNA, 160 bp, Homo sapiens
  misc_feature: GYAE6OF01CS53A.51.15.B04.1.454.CMB.1.raw
  modified_base (128)..(129): a, c, t, g, unknown or other
  misc_feature (128)..(129): n is a, c, g, or t
  modified_base (131)..(131): a, c, t, g, unknown or other
  misc_feature (131)..(131): n is a, c, g, or t
  modified_base (133)..(160): a, c, t, g, unknown or other
  misc_feature (133)..(160): n is a, c, g, or t
tcagcgatcgtatacacgaccggtgctcgatttagacagtatatatccgcgggctggcaaggcgcatagctgcctggtcaaggactacttcctcgtagcactctgagcgggctggcaaggcgcatagnncngnnnnnnnnnnnnnnnnnnnnnnnnnnnn

SEQ ID NO: 148227 - DNA, 161 bp, Homo sapiens
  misc_feature: GYAE6OF01AZUJQ.51.15.B04.1.454.CMB.1.raw
  modified_base (156)..(161): a, c, t, g, unknown or other
  misc_feature (156)..(161): n is a, c, g, or t
tcagcgatcgtatacacgaccggtgctcgatttagacagtatatatccgcgggcacgaccggtgctcgatttagagtgctacgaagggaaaggcagcgtcactctgttcccaccctcctctcgtagcactctgagcgggctggcaaggcgcatagnnnnnn

SEQ ID NO: 148228 - DNA, 159 bp, Homo sapiens
  misc_feature: GYAE6OF01ENB2W.51.15.B04.1.454.CMB.1.raw
  modified_base (157)..(159): a, c, t, g, unknown or other
  misc_feature (157)..(159): n is a, c, g, or t
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnnn

SEQ ID NO: 148229 - DNA, 158 bp, Homo sapiens; identical to SEQ ID NO: 148215
  misc_feature: GYAE6OF01A78TW.51.15.B04.1.454.CMB.1.raw
  modified_base (157)..(158): a, c, t, g, unknown or other
  misc_feature (157)..(158): n is a, c, g, or t

SEQ ID NO: 148230 - DNA, 261 bp, Homo sapiens
  misc_feature: GYAE6OF01D5A31.51.15.B04.1.454.CMB.1.raw
  modified_base (259)..(261): a, c, t, g, unknown or other
  misc_feature (259)..(261): n is a, c, g, or t
tcagcgatcgtatacacgaccggtgctcgatttagacagtatatatccgcgggaccggtgctcgatttagacagtatatatccgcgggcacgaccggtgctcgatttagctctacgctcagggcacgaccggtgctcgatttagctctacgctcagggcgaccggtgctcgatttagagtgctacgaagggaaaggcagcgtcactctgttcccgccctcctctcgtagcactctgagcgggctggcaaggcgcatagnnn

SEQ ID NO: 148231 - DNA, 158 bp, Homo sapiens
  misc_feature: GYAE6OF01C9PWV.51.15.B04.1.454.CMB.1.raw
  modified_base (157)..(158): a, c, t, g, unknown or other
  misc_feature (157)..(158): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnn

SEQ ID NO: 148232 - DNA, 195 bp, Homo sapiens
  misc_feature: GYAE6OF01EUK91.51.15.B04.1.454.CMB.1.raw
  modified_base (195)..(195): a, c, t, g, unknown or other
  misc_feature (195)..(195): n is a, c, g, or t
tcagcgatcgtatacacgaccggtgctcgatttagacagtatatatccgcgggcacgaccggtgctcgatttagtcgagctctctcgcgggcacgaccggtgctcgatttagagtgctacgaagggaaagggcagcgtcactctgttcccaccctcctctcgtagcactctgagcgggctggcaaggcgcatagn

SEQ ID NO: 148233 - DNA, 197 bp, Homo sapiens
  misc_feature: GYAE6OF01B0NC9.51.15.B04.1.454.CMB.1.raw
  modified_base (193)..(197): a, c, t, g, unknown or other
  misc_feature (193)..(197): n is a, c, g, or t
tcagcgatcgtatacacgaccggtgctcgatttagacagtatatatccgcgggcacgaccggtgctcgatttagctctacgctcagggcacgaccggtgctcgatttagtgtcacacgaagggaaagggcagcgtcactctgttccccaccctcctctcgtagcactctgagcgggctggcaaggcgcatagnnnnn

SEQ ID NO: 148234 - DNA, 238 bp, Homo sapiens
  misc_feature: GYAE6OF01A10J1.51.15.B04.1.454.CMB.1.raw
  modified_base (137)..(137): a, c, t, g, unknown or other
  misc_feature (137)..(137): n is a, c, g, or t
  modified_base (173)..(238): a, c, t, g, unknown or other
  misc_feature (173)..(238): n is a, c, g, or t
tcagcgatcgtatacacgaccggtgctcgatttagacagtatataagtaccgggcgggcaacgaccggtgctcgatttagaggtgctaccgaagggaaagggcagcggtcactctgttcccgccctccctctcgtanccactctgaggcgggctgggcaagggccgcatagcnnnnnnnnnnnnnnnnnnnnnnnnnnnnnnnnnnnnnnnnnnnnnnnnnnnnnnnnnnnnnnnnnn

SEQ ID NO: 148235 - DNA, 159 bp, Homo sapiens
  misc_feature: GYAE6OF01CL7X4.51.15.B04.1.454.CMB.1.raw
  modified_base (156)..(159): a, c, t, g, unknown or other
  misc_feature (156)..(159): n is a, c, g, or t
tcagcgatcgtatacacgaccggtgctcgatttagacagtatatatccgcgggcacgaccggtgctcgatttagagtgctacgaagggaaagggcagcgtcactctgttcccgcctcctctcgtagcactctgagcgggctggcaaggcgcatagnnnn

SEQ ID NO: 148236 - DNA, 161 bp, Homo sapiens
  misc_feature: GYAE6OF01BPEZ4.51.15.B04.1.454.CMB.1.raw
  modified_base (157)..(161): a, c, t, g, unknown or other
  misc_feature (157)..(161): n is a, c, g, or t
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnnnnn

SEQ ID NO: 148237 - DNA, 159 bp, Homo sapiens; identical to SEQ ID NO: 148228
  misc_feature: GYAE6OF01DX9SO.51.15.B04.1.454.CMB.1.raw
  modified_base (157)..(159): a, c, t, g, unknown or other
  misc_feature (157)..(159): n is a, c, g, or t

SEQ ID NO: 148238 - DNA, 233 bp, Homo sapiens
  misc_feature: GYAE6OF01ER2R7.51.15.B04.1.454.CMB.1.raw
  modified_base (159)..(159): a, c, t, g, unknown or other
  misc_feature (159)..(159): n is a, c, g, or t
  modified_base (165)..(233): a, c, t, g, unknown or other
  misc_feature (165)..(233): n is a, c, g, or t
tcagcgatcgtatacacgaccggtgctcgattttagacagtatatacccgcggggtcggacgaccggtgctcgatttagctgtgcgtcgaagggaagggcagcgtcactcgtcgttcccaccctcctgtagccacgtctgagcgggctggcaagggccncatagnnnnnnnnnnnnnnnnnnnnnnnnnnnnnnnnnnnnnnnnnnnnnnnnnnnnnnnnnnnnnnnnnnnnn

SEQ ID NO: 148239 - DNA, 157 bp, Homo sapiens
  misc_feature: GYAE6OF01A8OMT.51.15.B04.1.454.CMB.1.raw
tcagcgatcgtatacacgaccggtgctcgatttagacagtatatatccgcgggcacgaccggtgctcgatttagctgtgcgtcgaagggaaagggcagcgtcactctgttcccaccctcctctcgtagcactctgagcgggctggcaaggcgcatag

SEQ ID NO: 148240 - DNA, 157 bp, Homo sapiens
  misc_feature: GYAE6OF01DTKAD.51.15.B04.1.454.CMB.1.raw
  modified_base (157)..(157): a, c, t, g, unknown or other
  misc_feature (157)..(157): n is a, c, g, or t
tcagcgatcgtatacacgaccggtgctcgatttagacagtatatatccgcgggcacgaccggtgctcgatttagtcacgcgagaaagggaaaggcagcgtcactctgttcccaccctcctctcgtagcactctgagcgggctggcaaggcgcatagn

SEQ ID NO: 148241 - DNA, 156 bp, Homo sapiens
  misc_feature: GYAE6OF01DKPNZ.51.15.B04.1.454.CMB.1.raw
tcagcgatcgtatacacgaccggtgctcgatttagacagtatatatccgcgggcacgaccggtgctcgatttagctacgactgcaagggaaaggcagcgtcactctgttcccgccctcctctcgtagcactctgagcgggctggcaaggcgcatag

SEQ ID NO: 148242 - DNA, 157 bp, Homo sapiens; identical to SEQ ID NO: 148210
  misc_feature: GYAE6OF01EQ3KT.51.15.B04.1.454.CMB.1.raw
  modified_base (157)..(157): a, c, t, g, unknown or other
  misc_feature (157)..(157): n is a, c, g, or t

SEQ ID NO: 148243 - DNA, 157 bp, Homo sapiens; identical to SEQ ID NO: 148210
  misc_feature: GYAE6OF01BPPQ2.51.15.B04.1.454.CMB.1.raw
  modified_base (157)..(157): a, c, t, g, unknown or other
  misc_feature (157)..(157): n is a, c, g, or t

SEQ ID NO: 148244 - DNA, 156 bp, Homo sapiens
  misc_feature: GYAE6OF01D0W7G.51.15.B04.1.454.CMB.1.raw
  modified_base (150)..(156): a, c, t, g, unknown or other
  misc_feature (150)..(156): n is a, c, g, or t
tcagcgatcgtatacacgaccggtgctcgatttagacagtatatatccgcgggcacgaccggtgctcgatttagacagtatatatccgcgggcacgaccggtgctcgatttagacagttatatatcgagcgggctggcaaggcgcatagnnnnnnn

SEQ ID NO: 148245 - DNA, 293 bp, Homo sapiens
  misc_feature: GYAE6OF01BVSBF.51.15.B04.1.454.CMB.1.raw
  modified_base (288)..(293): a, c, t, g, unknown or other
  misc_feature (288)..(293): n is a, c, g, or t
tcagcgatcgtatacacgaccggtgctcgatttagacagtatatatccgcgggcacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgcatctgacgtagcactctgagcgggctggcaaggcgcatagnnnnnn

SEQ ID NO: 148246 - DNA, 295 bp, Homo sapiens
  misc_feature: GYAE6OF01EM4X2.51.15.B04.1.454.CMB.1.raw
  modified_base (291)..(295): a, c, t, g, unknown or other
  misc_feature (291)..(295): n is a, c, g, or t
tcagcgatcgtatacacgaccggtgctcgatttagacagtatatatccgcgggcacgaccggtgctcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgttcccgccatctgatcgtagcactctgagcggctggcaaggcgcatagnnnnn

SEQ ID NO: 148247 - DNA, 162 bp, Homo sapiens
  misc_feature: GYAE6OF01C857L.51.15.B04.1.454.CMB.1.raw
  modified_base (157)..(162): a, c, t, g, unknown or other
  misc_feature (157)..(162): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnnnnn

SEQ ID NO: 148248 - DNA, 159 bp, Homo sapiens
  misc_feature: GYAE6OF01C8NOQ.51.15.B04.1.454.CMB.1.raw
  modified_base (157)..(159): a, c, t, g, unknown or other
  misc_feature (157)..(159): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnn

SEQ ID NO: 148249 - DNA, 130 bp, Homo sapiens
  misc_feature: GYAE6OF02GM77V.51.15.B04.1.454.CMB.1.raw
  modified_base (128)..(130): a, c, t, g, unknown or other
  misc_feature (128)..(130): n is a, c, g, or t
tcagcgatcgtatacacgaccggtgctcgatttagacagtatatatccgcgggctggcaaggcgcatagctgcctggtcaaggactacttcctcgtagcactctgagcgggctggcaaggcgcatagnnn

SEQ ID NO: 148250 - DNA, 157 bp, Homo sapiens
  misc_feature: GYAE6OF02GNUGT.51.15.B04.1.454.CMB.1.raw
  modified_base (156)..(157): a, c, t, g, unknown or other
  misc_feature (156)..(157): n is a, c, g, or t
tcagcgatcgtatacacgaccggtgctcgatttagacagtatatatccgcgggcacgaccggtgctcgatttagagtgctacgaagggaaagggcagcgtcactctgttcccgcctcctctcgtagcactctgagcgggctggcaaggcgcatagnn

SEQ ID NO: 148251 - DNA, 157 bp, Homo sapiens
  misc_feature: GYAE6OF02ISSW3.51.15.B04.1.454.CMB.1.raw
  modified_base (157)..(157): a, c, t, g, unknown or other
  misc_feature (157)..(157): n is a, c, g, or t
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagn

SEQ ID NO: 148252 - DNA, 197 bp, Homo sapiens
  misc_feature: GYAE6OF02FO0QW.51.15.B04.1.454.CMB.1.raw
  modified_base (192)..(197): a, c, t, g, unknown or other
  misc_feature (192)..(197): n is a, c, g, or t
tcagcgatcgtatacacgaccggtgctcgatttagacagtatatatccgcgggcacgaccggtgctcatttagacagtatatatccgcgggcacgaccggtgctcgattagagtgctacgaagggaaaggcagcgtcactctgttcccgcctcctctcgtagcactctgagcgggctggcaaggcgcatagnnnnnn

SEQ ID NO: 148253 - DNA, 158 bp, Homo sapiens; identical to SEQ ID NO: 148215
  misc_feature: GYAE6OF02GB0TL.51.15.B04.1.454.CMB.1.raw
  modified_base (157)..(158): a, c, t, g, unknown or other
  misc_feature (157)..(158): n is a, c, g, or t

SEQ ID NO: 148254 - DNA, 150 bp, Homo sapiens
  misc_feature: GYAE6OF02HHHY6.51.15.B04.1.454.CMB.1.raw
  modified_base (126)..(150): a, c, t, g, unknown or other
  misc_feature (126)..(150): n is a, c, g, or t
tcagcgatcgtatacacgaccggtgctcgatttagacagtatatatccgcgggctggcaaggcgcatagctgcctggtcaaggactacttctcgtagactctgagcgggctggcaaggcgcatagnnnnnnnnnnnnnnnnnnnnnnnnn

SEQ ID NO: 148255 - DNA, 233 bp, Homo sapiens
  misc_feature: GYAE6OF02F23CP.51.15.B04.1.454.CMB.1.raw
  modified_base (232)..(233): a, c, t, g, unknown or other
  misc_feature (232)..(233): n is a, c, g, or t
tcagcgatcgtatacacgaccggtgctcgatttagacagtatatatccgcgggcacgaccggtgctcgatttagctctacgctcagggcacgaccggtgctcgatttagagtgctacgaagggaagggcactaccggtgctcgatttagagtgctacgaagggaaagggcagcgtcactctgttcccgccctcctctcgtagcactctgagcgggctggcaaggcgcatagnn

SEQ ID NO: 148256 - DNA, 157 bp, Homo sapiens; identical to SEQ ID NO: 148251
  misc_feature: GYAE6OF02F7SIM.51.15.B04.1.454.CMB.1.raw
  modified_base (157)..(157): a, c, t, g, unknown or other
  misc_feature (157)..(157): n is a, c, g, or t

SEQ ID NO: 148257 - DNA, 180 bp, Homo sapiens
  misc_feature: GYAE6OF02I96ZR.51.15.B04.1.454.CMB.1.raw
  modified_base (158)..(180): a, c, t, g, unknown or other
  misc_feature (158)..(180): n is a, c, g, or t
tcagcgatcgtatacacgaccggtgctcgatttagacagtatatatccgcgggcacgaccggtgctcgatttagctgtcgcgtcgaagggaaagggcagcgtcactctgttcccccctcctctcgtagcactctgagcgggctggcaaggcgcatagnnnnnnnnnnnnnnnnnnnnnnn

SEQ ID NO: 148258 - DNA, 192 bp, Homo sapiens
  misc_feature: GYAE6OF02H1UKQ.51.15.B04.1.454.CMB.1.raw
  modified_base (192)..(192): a, c, t, g, unknown or other
  misc_feature (192)..(192): n is a, c, g, or t
tcagcgatcgtatacacgaccggtgctcgatttagacagtatatatccgcgggcacgaccggtgctcgatttagctacgctctaagggcacgaccggtgctcgatttagagtgctacgaagggaaagggcagcgtcactctgttcccgccctcctctcgtagcactctgagcgggctggcaaggcgcatagn

SEQ ID NO: 148259 - DNA, 157 bp, Homo sapiens; identical to SEQ ID NO: 148210
  misc_feature: GYAE6OF02GZOXH.51.15.B04.1.454.CMB.1.raw
  modified_base (157)..(157): a, c, t, g, unknown or other
  misc_feature (157)..(157): n is a, c, g, or t

SEQ ID NO: 148260 - DNA, 157 bp, Homo sapiens; identical to SEQ ID NO: 148251
  misc_feature: GYAE6OF02FK0FL.51.15.B04.1.454.CMB.1.raw
  modified_base (157)..(157): a, c, t, g, unknown or other
  misc_feature (157)..(157): n is a, c, g, or t

SEQ ID NO: 148261 - DNA, 233 bp, Homo sapiens
  misc_feature: GYAE6OF02G96A8.51.15.B04.1.454.CMB.1.raw
  modified_base (230)..(233): a, c, t, g, unknown or other
  misc_feature (230)..(233): n is a, c, g, or t
tcagcgatcgtatacacgaccggtgctcgatttagacagtatatatccgcgggcacgaccggtgctcgatttagacagtatatatccgcggcacgaccggtgctcgatttagctctacgctcagggcacgaccggtgctcgatttagtcacgcgagaaagggaaaggcagcgtcactctgttcccaccctcctctcgtagcactctgagcgggctggcaaggcgcatagnnnn

SEQ ID NO: 148262 - DNA, 199 bp, Homo sapiens
  misc_feature: GYAE6OF02FO1W6.51.15.B04.1.454.CMB.1.raw
  modified_base (198)..(199): a, c, t, g, unknown or other
  misc_feature (198)..(199): n is a, c, g, or t
tcagcgatcgtatacacgaccggtgctcgatttagacagtatatatccgcgggcacgaccggtgctcgatttagagtgctacgaagggaaagggcacgaccggtgctcgatttagagtgctacgaagggaaagggcagcgtcactctgttcccgccctcctctcgtagcactctgagcgggctggcaaggcgcatagnn

SEQ ID NO: 148263 - DNA, 157 bp, Homo sapiens; identical to SEQ ID NO: 148251
  misc_feature: GYAE6OF02I1T3C.51.15.B04.1.454.CMB.1.raw
  modified_base (157)..(157): a, c, t, g, unknown or other
  misc_feature (157)..(157): n is a, c, g, or t

SEQ ID NO: 148264 - DNA, 110 bp, Homo sapiens
  misc_feature: GYAE6OF02GE86M.51.15.B04.1.454.CMB.1.raw
  modified_base (109)..(110): a, c, t, g, unknown or other
  misc_feature (109)..(110): n is a, c, g, or t
tcagcgatcgtatacacgaccggtgctcgatttagacagtatatatccgcgggcacgaccggtgctcgatttagtgtgagtagttcagcgggctggcaaggcgcatagnn

SEQ ID NO: 148265 - DNA, 159 bp, Homo sapiens
  misc_feature: GYAE6OF02JPVC0.51.15.B04.1.454.CMB.1.raw
  modified_base (156)..(159): a, c, t, g, unknown or other
  misc_feature (156)..(159): n is a, c, g, or t
tcagcgatcgtatacacgaccggtgctcgatttagacagtatatatccgcgggcacgaccggtgctcgatttagagtgctacgaagggaaagggcagcgtcactctgttcccgcctcttctcgtagcactctgagcgggctggcaaggcgcatagnnnn

SEQ ID NO: 148266 - DNA, 158 bp, Homo sapiens; identical to SEQ ID NO: 148215
  misc_feature: GYAE6OF02F8QM2.51.15.B04.1.454.CMB.1.raw
  modified_base (157)..(158): a, c, t, g, unknown or other
  misc_feature (157)..(158): n is a, c, g, or t

SEQ ID NO: 148267 - DNA, 254 bp, Homo sapiens
  misc_feature: GYAE6OF02FFY0N.51.15.B04.1.454.CMB.1.raw
  modified_base (125)..(125): a, c, t, g, unknown or other
  misc_feature (125)..(125): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (243)..(254): a, c, t, g, unknown or other
  misc_feature (243)..(254): n is a, c, g, or t
tcagcgatcgtatacacgaccggtgctcgatttagacagtatatatccgcgggcacgaccggtgctcgatttagacagtatatatccgcgggcacgaccggtgctcgattttagactagtactanagtaccggcggcacgaccggtgctcgtacgttacgacgtgcgtagaggaacggcagcgtcgactcgntaccggcctcctntacggtagcactctgagcgggctggcaaggcgcatagnnnnnnnnnnnn

SEQ ID NO: 148268 - DNA, 158 bp, Homo sapiens; identical to SEQ ID NO: 148215
  misc_feature: GYAE6OF02GBG0B.51.15.B04.1.454.CMB.1.raw
  modified_base (157)..(158): a, c, t, g, unknown or other
  misc_feature (157)..(158): n is a, c, g, or t

SEQ ID NO: 148269 - DNA, 161 bp, Homo sapiens
  misc_feature: GYAE6OF02FU3YJ.51.15.B04.1.454.CMB.1.raw
  modified_base (157)..(161): a, c, t, g, unknown or other
  misc_feature (157)..(161): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnnnn

SEQ ID NO: 148270 - DNA, 156 bp, Homo sapiens
  misc_feature: GYAE6OF02GJNSX.51.15.B04.1.454.CMB.1.raw
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatag

SEQ ID NO: 148271 - DNA, 157 bp, Homo sapiens; identical to SEQ ID NO: 148251
  misc_feature: GYAE6OF02GS9M8.51.15.B04.1.454.CMB.1.raw
  modified_base (157)..(157): a, c, t, g, unknown or other
  misc_feature (157)..(157): n is a, c, g, or t

SEQ ID NO: 148272 - DNA, 173 bp, Homo sapiens
  misc_feature: GYAE6OF02GM1TO.51.15.B04.1.454.CMB.1.raw
  modified_base (172)..(173): a, c, t, g, unknown or other
  misc_feature (172)..(173): n is a, c, g, or t
tcagcgatcgtatacacgaccggtgctcgatttagacagtatatatccgcggggtatatatccgcgggcacgaccggtgctcgatttagagtgctacgaagggaaagggcagcgtcactctgttcccgccctcctctcgtagcactctgagcgggctggcaaggcgcatagnn

SEQ ID NO: 148273 - DNA, 161 bp, Homo sapiens
  misc_feature: GYAE6OF02GO15P.51.15.B04.1.454.CMB.1.raw
  modified_base (158)..(161): a, c, t, g, unknown or other
  misc_feature (158)..(161): n is a, c, g, or t
tcagcgatcgtatacacgaccggtgctcgatttagacagtatatatccgcgggcacgaccggtgctcgatttagctacgactgcaagggaaagggcagcgtcactctgttcccaccctcctctcgtagcactctgagcgggctggcaaggcgcatagnnnn

SEQ ID NO: 148274 - DNA, 157 bp, Homo sapiens; identical to SEQ ID NO: 148210
  misc_feature: GYAE6OF02F7O70.51.15.B04.1.454.CMB.1.raw
  modified_base (157)..(157): a, c, t, g, unknown or other
  misc_feature (157)..(157): n is a, c, g, or t

SEQ ID NO: 148275 - DNA, 208 bp, Homo sapiens
  misc_feature: GYAE6OF02GKO35.51.15.B04.1.454.CMB.1.raw
  modified_base (162)..(164): a, c, t, g, unknown or other
  misc_feature (162)..(164): n is a, c, g, or t
  modified_base (166)..(208): a, c, t, g, unknown or other
  misc_feature (166)..(208): n is a, c, g, or t
tcagcgatcgtatacacgaccggtgctcgatttagacagtatatataccggacggggcacgaccggtgctcgatttaggacacatacgcagggaaaggcagcgtcactctgttcccgccctcctctcgtagcactctgagcgggctggccaaggcgcatagnnngnnnnnnnnnnnnnnnnnnnnnnnnnnnnnnnnnnnnnnnnnnn

SEQ ID NO: 148276 - DNA, 197 bp, Homo sapiens
  misc_feature: GYAE6OF02G6SW5.51.15.B04.1.454.CMB.1.raw
  modified_base (195)..(197): a, c, t, g, unknown or other
  misc_feature (195)..(197): n is a, c, g, or t
tcagcgatcgtatacacgaccggtgctcgatttagacagtatatatccgcgggcacgaccggtgctcgatttagacagtatatatccgcgggcacgaccggtgctcgatttagacacatacgcagggaaagggcagcgtcactctgttcccaccctctctcgtagcactctgagcgggctggcaaggcgcatagnnn

SEQ ID NO: 148277 - DNA, 196 bp, Homo sapiens
  misc_feature: GYAE6OF02G47RQ.51.15.B04.1.454.CMB.1.raw
  modified_base (195)..(196): a, c, t, g, unknown or other
  misc_feature (195)..(196): n is a, c, g, or t
tcagcgatcgtatacacgaccggtgctcgatttagacagtatatatccgcgggcacgaccggtgctcgatttagacagtatatatccgcgggcacgaccggtgctcgatttagctgtgcgtcgaagggaaaggcagcgtcactctgttcccgccctcctctcgtagcactctgagcggctggcaaggcgcatagnn

SEQ ID NO: 148278 - DNA, 171 bp, Homo sapiens
  misc_feature: GYAE6OF02FRH6O.51.15.B04.1.454.CMB.1.raw
  modified_base (157)..(171): a, c, t, g, unknown or other
  misc_feature (157)..(171): n is a, c, g, or t
tcagcgatcgtatacacgaccggtgctcgatttagacagtatatatccgcgggcacgaccggtgctcgatttagagtgctacgaagggaaagggcagcgtcactctgttcccaccctcctctcgtagcactctgagcgggctggcaaggcgcatagnnnnnnnnnnnnnnn

SEQ ID NO: 148279 - DNA, 159 bp, Homo sapiens; identical to SEQ ID NO: 148248
  misc_feature: GYAE6OF02FZGRD.51.15.B04.1.454.CMB.1.raw
  modified_base (157)..(159): a, c, t, g, unknown or other
  misc_feature (157)..(159): n is a, c, g, or t

SEQ ID NO: 148280 - DNA, 297 bp, Homo sapiens
  misc_feature: GYAE6OF02HXGMI.51.15.B04.1.454.CMB.1.raw
  modified_base (293)..(297): a, c, t, g, unknown or other
  misc_feature (293)..(297): n is a, c, g, or t
tcagcgatcgtatacacgaccggtgctcgatttagacagtatatatccgcgggcacgaccggtgctcgatttagagctcacgtattggggggcaaagctgccctgaccctttcgggtgcgcagcctgaggatgaggctgagtattactgcttgatctcctatagtggtgttcgggtgttcggcggagggaccaagctgaccgtcctaggtcagcccaaggctgccccctcggtcactctgttccccgccatctgatcgtagcactctgagcggggctggcaaggcgcaatagnnnnn

SEQ ID NO: 148281 - DNA, 194 bp, Homo sapiens
  misc_feature: GYAE6OF02FL0E3.51.15.B04.1.454.CMB.1.raw
  modified_base (192)..(194): a, c, t, g, unknown or other
  misc_feature (192)..(194): n is a, c, g, or t
tcagcgatcgtatacacgaccggtgctcgatttagacagtatatatccgcgggcacgaccggtgctcgatttagctctacgctcagggcacgaccggtgctcgatttagagtgctacgaagggaaagggcagcgtcactctgttcccaccctcctctcgtagcactctgagcgggctggcaaggcgcatagnnn

SEQ ID NO: 148282 - DNA, 191 bp, Homo sapiens
  misc_feature: GYAE6OF02I88B6.51.15.B04.1.454.CMB.1.raw
  modified_base (159)..(191): a, c, t, g, unknown or other
  misc_feature (159)..(191): n is a, c, g, or t
tcagcgatcgtatacacgaccggtgctcgatttagacagtatatatccgcgggcacgaccggtgctcgatttagagtgctacgaagggaaagggcagcgtcactcctgttcccgccctcctctcggtagcactctgagcgggctggcaaggcgcatagnnnnnnnnnnnnnnnnnnnnnnnnnnnnnnnnn

SEQ ID NO: 148283 - DNA, 160 bp, Homo sapiens
  misc_feature: GYAE6OF02FJ2AU.51.15.B04.1.454.CMB.1.raw
  modified_base (157)..(160): a, c, t, g, unknown or other
  misc_feature (157)..(160): n is a, c, g, or t
tcagcgatcgtatacacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnnn

SEQ ID NO: 148284 - DNA, 201 bp, Homo sapiens
  misc_feature: GYAE6OF02GX7E5.51.15.B04.1.454.CMB.1.raw
  modified_base (196)..(201): a, c, t, g, unknown or other
  misc_feature (196)..(201): n is a, c, g, or t
tcagcgatcgtatacacgaccggtgctcgatttagacagtatatatccgcgggcacgaccggtgctcgatttagacagtatatatccgcgggcacgaccggtgctcgatttagagtgctacgaagggaaagggcagcgtcactctgttcccgccctcctctcgtagcactctgagcgggctggcaaggcgcatagnnnnnn

SEQ ID NO: 148285 - DNA, 270 bp, Homo sapiens
  misc_feature: GYAE6OF02HVX4G.51.15.B04.1.454.CMB.1.raw
  modified_base (246)..(246): a, c, t, g, unknown or other
  misc_feature (246)..(246): n is a, c, g, or t
  modified_base (252)..(270): a, c, t, g, unknown or other
  misc_feature (252)..(270): n is a, c, g, or t
tcagcgatcgtatacacgaccggtgctcgatttagacagtatatatccgcgggcacgaccggtgctcgatttagacagtatatatccgcgggcacgaccggtgctcgattttagactagtatactagtaccgcggacacgaccggtgcctcgactttacgacgttgctacgaaggaacggtcagcgtcgactcgtcgttacccgaccctcctacgtgacgcactctgacgcggctgggacaaggcnaatgcnnnnnnnnnnnnnnnnnnn

SEQ ID NO: 148286 - DNA, 135 bp, Homo sapiens
  misc_feature: GYAE6OF02G6W51.51.15.B04.1.454.CMB.1.raw
  modified_base (128)..(135): a, c, t, g, unknown or other
  misc_feature (128)..(135): n is a, c, g, or t
tcagcgatcgtatacacgaccggtgctcgatttagacagtatatatccgcgggctggcaaggcgcatagctgcctggtcaaggactacttcctcgtagcactctgagcgggctggcaaggcgcatagnnnnnnnn

SEQ ID NO: 148287 - DNA, 155 bp, Homo sapiens
  misc_feature: GYAE6OF01DCLNX.10.14.B03.1.454.CMB.1.raw
  modified_base (155)..(155): a, c, t, g, unknown or other
  misc_feature (155)..(155): n is a, c, g, or t
tcagcatagtagtgcacgaccggtgctcgatttagtgtgagtagttccgcgggggaccaacctgaccgtcctaggtcagcccaaggctgcccctcggtcactctgttcccaccctcctccactactatgctgagcgggctggcaaggcgcatagn

SEQ ID NO: 148288 - DNA, 158 bp, Homo sapiens
  misc_feature: GYAE6OF01B290A.10.14.B03.1.454.CMB.1.raw
  modified_base (157)..(158): a, c, t, g, unknown or other
  misc_feature (157)..(158): n is a, c, g, or t
tcagcatagtagtgcacgaccggtgctcgatttagtgtgagtagttccgcggggggaccaacctgaccgtcctaggtcagcccaaggctgccccctcggtcactctgttcccgccctcctccactactatgctgagcgggctggcaaggcgcatagnn

SEQ ID NO: 148289 - DNA, 154 bp, Homo sapiens
  misc_feature: GYAE6OF02HO7VB.10.14.B03.1.454.CMB.1.raw
  modified_base (154)..(154): a, c, t, g, unknown or other
  misc_feature (154)..(154): n is a, c, g, or t
tcagcatagtagtgcacgaccggtgctcgatttagtgtgagtagttccgcggggaccaacctgaccgtcctaggtcagcccaaggctgcccctcggtcactctgttcccgccctcctccactactatgctgagcgggctggcaaggcgcatagn

SEQ ID NO: 148290 - DNA, 154 bp, Homo sapiens
  misc_feature: GYAE6OF02HQP89.10.14.B03.1.454.CMB.1.raw
tcagcatagtagtgcacgaccggtgctcgatttagtgtgagtagttccgcgggggaccaacctgaccgtcctaggtcagcccaaggctgcccctcggtcactctgttcccgccctcctccactactatgctgagcgggctggcaaggcgcatag

SEQ ID NO: 148291 - DNA, 155 bp, Homo sapiens
  misc_feature: GYAE6OF02FQTMB.10.14.B03.1.454.CMB.1.raw
tcagcatagtagtgcacgaccggtgctcgatttagtgtgagtagttccgcgggggaccaacctgaccgtcctaggtcagcccaaggctgccccctcggtcactctgttcccaccctcctccactactatgctgagcgggctggcaaggcgcatag

SEQ ID NO: 148292 - DNA, 501 bp, Homo sapiens
  misc_feature: GYAE6OF01C4B8J.40.83.H06.1.454.CMB.1.raw
  modified_base (347)..(347): a, c, t, g, unknown or other
  misc_feature (347)..(347): n is a, c, g, or t
  modified_base (421)..(421): a, c, t, g, unknown or other
  misc_feature (421)..(421): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactggaacagcgacaatgttggcgcccaaggagcagcttggctgcagcagtaccagggccgccctcccaaactccctcctcccacacggtctggccgaccggccctcgagggactctcagagagatattcngcatccaggttcgcgaacacagccctcctgaccatcactggactcaacgcctgagacgaggctagactattacngttcagcagtgggacgcagcctcgagtgaagtgggtgttcgggcggaggaccaacgtcgtaccgtacgtaggcagacccg

SEQ ID NO: 148293 - DNA, 540 bp, Homo sapiens
  misc_feature: GYAE6OF01DA9UX.40.83.H06.1.454.CMB.1.raw
  modified_base (454)..(454): a, c, t, g, unknown or other
  misc_feature (454)..(454): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactccctcctcccacaggtcctgggccgaccggccctcgagggatctcagagacgatattctgacatccaggttcgacgaacacacgccctcctacgaccatcactggaactcaagcctgaggacgaggctaggactattactgttcagcagtgggacggcagcctnaggtcgaagttcggggtagttcgggcgggtaacgggaacctaaacgttcggtacccgttaccgtaacggtcgaccggtaaccccgg

SEQ ID NO: 148294 - DNA, 681 bp, Homo sapiens
  misc_feature: GYAE6OF01DSC2M.40.83.H06.1.454.CMB.1.raw
  modified_base (222)..(222): a, c, t, g, unknown or other
  misc_feature (222)..(222): n is a, c, g, or t
  modified_base (377)..(377): a, c, t, g, unknown or other
  misc_feature (377)..(377): n is a, c, g, or t
tcagtctagcgactcacgaccggtgctcgatttagatcacgtgcgtcggcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggtttcctcgttgcttacttttaagnggtgtccagttgtcaggtgctagtggtggagtcgtgggggagtcgtggtccaggccgtagggaacgtcactgacgtactctcctgtgctagtccggtccgatttccgaccctttaccgaattaaactactaaacatcgacctacgtcgggtcccnccgaggtccctacgagggaccaaaggggtcctggccgtaggtcggcctacggaccctacgttcggtaccgttggggtaccggtagttaaggtaaaagtttgtacggtactaagttaaccttaagttcgactaacgtaccttcgtacgtgggacgggtaccctaagttccacgttctaacgttccgtaacgtacggaacgtaacgtaacgttaccggaaagtaaccgtaccggttactttaacgtacgtagtaactaaacgtagtaaaccgcgttacccgagaccgtaacggtcggtaaaccggg

SEQ ID NO: 148295 - DNA, 512 bp, Homo sapiens
  misc_feature: GYAE6OF01AXDEP.40.83.H06.1.454.CMB.1.raw
  modified_base (330)..(330): a, c, t, g, unknown or other
  misc_feature (330)..(330): n is a, c, g, or t
  modified_base (478)..(478): a, c, t, g, unknown or other
  misc_feature (478)..(478): n is a, c, g, or t
  modified_base (503)..(503): a, c, t, g, unknown or other
  misc_feature (503)..(503): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggtttcctcgttgctcttttaagaggtgtccagtgtcaggtgcagttggtggagtcgtggggggagcgtggtccagccgtgggaggtcactgagactctcctgtgcatcgtccgattcaccttcataaatataacntgcactgggtccgccaggctccaggcaagggctgcagtggctggccagtgtcgtggtcgatgaagttatgacatactatgcagactctcgtgacgggccgtattcatcacttcactagagtacaacttacgaagaacacggtacttanctagactaatgaacagacctagacngtcgaacgg

SEQ ID NO: 148296 - DNA, 549 bp, Homo sapiens
  misc_feature: GYAE6OF01C9QAX.40.83.H06.1.454.CMB.1.raw
  modified_base (342)..(342): a, c, t, g, unknown or other
  misc_feature (342)..(342): n is a, c, g, or t
  modified_base (401)..(401): a, c, t, g, unknown or other
  misc_feature (401)..(401): n is a, c, g, or t
  modified_base (460)..(460): a, c, t, g, unknown or other
  misc_feature (460)..(460): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttggggttttcctcgttgcttcttttaagagtgtccagtgtcaggtgcagttggtggagtcgtgggggagcgtggtccagcctgggagtcactgagactctctgtgcatcgtcgattcaccttcataaatataacatgcactgggtccnccaggctcaggcaagggctgcagtggctggccacgtgtctggtcggataggtaaagttntgctaagtactatgacagtacctctcgtggacgggtccgattcatctatctactagaanactaaagttacgaaagaaccgtacggtcttaactactaggaaacctaaagtagaaaccacgtacccttagaacctaggtacgaaacggg

SEQ ID NO: 148297 - DNA, 544 bp, Homo sapiens
  misc_feature: GYAE6OF01BNHPV.40.83.H06.1.454.CMB.1.raw
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (352)..(352): a, c, t, g, unknown or other
  misc_feature (352)..(352): n is a, c, g, or t
tcagtctagcgactcacgaccggtgctcgatttagatcacgtgcgtcgcggggtcgcggggctgccctttggttttggagattggttttctcgatggggtctgggagaggagcccagcactcgaagtcggcggtgttgccattcggtgatcagcactgaacacagaggactcaccatggagtttgggctgagcttgggttttcctcgttgcttcttttaagnggtntccagtgtcaggtgcagttggtggagtcgtggggggagcgtggtccagccgtgggagtcactgagactctcctgtgcagtcgtccggattccaccttcaataaatataacatgcacgtgggtcccncaggcctcgaggcaagggctgcaggtcgctggcctagttgtcgtggtcgatagtaagttagtagactatactatcgacagtactctcgtggacggggacctattcactcatctagtagagactaattacgaaagacacgtacttactctagactaaagtacgaaacgtacgacctagactaggtcggaacgg

SEQ ID NO: 148298 - DNA, 668 bp, Homo sapiens
  misc_feature: GYAE6OF01DTXUG.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttgggttttcctcgttgcttcgttttaagaggtgtccagtgtcaggtgctaggttggtggagtcggtggggggaggcgtggtccaggccgtggggaggtcacgtgacgactctcctgtgcatccgtccggtattccaccttccaattaaatataacatgactacgtcgggtccgccgaggcctaccgaggcgaagggctggacaggtggctcggcctacgtcggtcgtgggtcgtagtaggtaaagttagtagactatactagtcgacgtacgtaccttcgtcggtacgggacggggtaccgtacttccgtacgttacctacgttccgttaacgttaaggaacgtaacgtaaacgttaacccggaaacggtaaaccgtacccgggttaactttacgttacgtaacggtaaacctaaaagttaccgaaaccgtacggtacccttaaggaaccgtaacgggtaccggtaaacccggg

SEQ ID NO: 148299 - DNA, 607 bp, Homo sapiens
  misc_feature: GYAE6OF01CZ9IE.40.83.H06.1.454.CMB.1.raw
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcggtcgttcgcgtagcgtcttaagaggtntcngtgtnagtgangtgtgagtgtggggnggcgtgcgngcgtggngtcagtgagctctcgtgtgtcncgtcgtcgtactactctactaataataataatactagcgacgtcggtccgcgacgcgtacgacggacgaggtacgcgcgtaggtcgcgtcgaccgtacgtcgtcgtacggtacggtagtaagtaagttagtacgtacgtaatacgtagtacgacgtacgtaccgtcgtcggtacgggtacgggtaccgtactactactactacgtacgtaacgtacgtaacgtaacgtaacgtaacgtaacgaaaccgtaacgtacgttacgtacgtacgtaacgtaacgtaacgtaacgtacgtacgtaaccgacgtacggtacggacg

SEQ ID NO: 148300 - DNA, 626 bp, Homo sapiens
  misc_feature: GYAE6OF01CP6PA.40.83.H06.1.454.CMB.1.raw
  modified_base (460)..(460): a, c, t, g, unknown or other
  misc_feature (460)..(460): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttgggttttcctcgttgcttctttaagaggtgtccagtgtcaggtgctaggttggtggagtcggtgggggagcgtggtccagccgtgggagtcacgtgacgtactctccgtgtcgctagtccgtccgtattccaccttcaattaaatataacatcgactacgttcgggcccaccgaggtcctaccgaagggacccgaaaggggtcctggccgtagggtcgtcgtcggacctacgtggtcgtcgggtacgtagttaggtaaacgtttnacgtactatacgtatcgacaacgtacctcgtcgtacggacgggtacctattcattccgtactccgtacgtagacgactaacgttacgaaacgtacgtaccgttacttacgtacgtacgaactaaacgtacgaacgtacgtaccgtagaacgtcggtaacggaacgg

SEQ ID NO: 148301 - DNA, 719 bp, Homo sapiens
  misc_feature: GYAE6OF01AZSNU.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacacgaccgccacactcacctgcactgggaacagcgacaatgttggcgccaaggagcagcttggctgcagcagtaccgagggcccgcccctacccaaacctccctcctacccacgtacggtcctcgggccgacccggccctccggacgggtactccgtacgaaggaggaagtactttaagtttcgtcgacctacgttcccgtaagggtttacccgaccggaaaccaccgtaaccggtccccgttacccctaccggtaacccctacgttacccaaccgtacgggaacccttaccgaacgtcccgtagggaacggaccggaggtccgtagtacctttaacgttaccgttacggttaccgaggtacccgtaggttaccggggacggtccgaacgtcccgtacgtaggtacgggtagggttcggggttacgggttaccgggggccgggtaaacgggaacccgttaaacggttccgggttaccccggttacccgggttaaccgggtcccggtaacccgggtacccccggg

SEQ ID NO: 148302 - DNA, 752 bp, Homo sapiens
  misc_feature: GYAE6OF01DB4AY.40.83.H06.1.454.CMB.1.raw
  modified_base (450)..(450): a, c, t, g, unknown or other
  misc_feature (450)..(450): n is a, c, g, or t
tcagtctagcgactcacgaccggtgctcgatttagatcacgtgcgtcgcggggtcgcgggctgccctttggttttggagattggttttctcgagtggggtctgggagaggagcccagcactcgaagtcggcggtgttgccagttcggtgatcagcactgaacacagaggactcacagtggagtttgggctgagtcgttgggtttcctgttgcttacgttttaaggaggttgtccgagtgtcaggtgcgtaggttgggtggagtcggtgggggacgtcggtcggtccgaggccgtgggacgtcacgtgacgtactctccgtgtcgacgtacgtccggttcggtactttccaacctttaccaaattaaaacttactaaaccgtagttcgaccgtaacgttccgggtacccgtacccgaagggtcctaccggaagggacggaaagggttaccncggcgtaggtcggccgttggaccctaggttcgtacgtcgggttagtaacgttaggtaaacgtttgacggtactaagttacgttaacgtgaccgtaagttaccgttccggttacgtacggggtaaccggggttaccttaacggtttcctaacggttaccttaacgtttccgttaacgtaaaggtaaccgttaaacgtaaacggtttaaccggaaaacgtaaaccggtcgttaaccgttagttacccgaagtaaacccgaaagtaacgtaacgacgtacctaggaacgtacggtacggtaacgg

SEQ ID NO: 148303 - DNA, 594 bp, Homo sapiens
  misc_feature: GYAE6OF01BLMHY.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactggacagcgacatgtgcgccgaaggagcagcttggcttcagcacgtaccgacgggcccgaccccgtcccaaaacctcccgtcctacccacacggtctcggccgcccggccctacgacgggctcgtacagacgagtatattctgcactccaggttcgacgaaactaccacgtcctccctagaccctatccaacgttcggacttacgaaacgtcccgtaggaacggacgacggtctacgtaacttacgttacgtcgttacagcgtagtcgggacgtcacgcgtacgagtggtaaggtgggtcgttacgggacgggaacgggtacctaaaccggtcggttacccggtacgttaagggcccaacggtcccgtaaaccggg

SEQ ID NO: 148304 - DNA, 657 bp, Homo sapiens
  misc_feature: GYAE6OF01C5D90.40.83.H06.1.454.CMB.1.raw
  modified_base (221)..(221): a, c, t, g, unknown or other
  misc_feature (221)..(221): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcacatggagtttgggctgagcttgggttttcctcgttgcttcttttaaggnggttgtccagtgtcaggtgcagttggtggagtcgtgggggagcgtggtccagccgtgggagtcacgtgagactcctcctgtgcagtccgtcggtnttccaccttccaataaatataacatgcacgtcgggccnccgtaggcctccgaaggcaagggactgcgagtggctggcctacgtgtcgtggtacggattagtaaagttatgtactaattaccgtatcgtactacgtactccgttacggtacgggacggggtacccgtaagtttaccgtaacgtacctaacttccgttacgtaacgtaacgtaacgtaaacgtttaacccggaaaacgtaaacccggtaccggttaacgtttaacgtaacgttacggtaaactaaaacgttaacgaaacgtaaccgtacccgtaggaaccgtaacgggtacgggaaacccggg

SEQ ID NO: 148305 - DNA, 1116 bp, Homo sapiens
  misc_feature: GYAE6OF01ELPMO.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagagactcaccatggagtttgggctgagtcttgggttttcctcgttgtcttacgtttttaaggagggttcgtcctaggttgtccgaagggttgacgtaggtttggggtgggtacggttcgggtagggggggtacggtccggttcgggtccccgaaggtcccggttaggggggaacggttccgaacggttggaaccggttaccctttccgttcccgttgggttaccggtacccgttaacggtttccccggggtttaccccggggttaactttttacccccggtaaacccccgtttttaacccgtaaaaagttttaaaaaactttaacgtttaaaaaaccccgtaaggtttcccgggtaacccttaaaccccggggtttccggggggttacccccccggaaccccggtaaaccgggggttccccccgtttaaaccccggggaaaacgggggggaaccccgtaaaaacggggggggttacccctttacggggaaccggtaaccgggggtttccgggggtacccggtttacccgggacccccgtttaaaccgggttttcgggggtttacccggttacggggggtttacccgggtaaaaggttttaacgggggtttaaaaaacggttttacggtttaaccggtaaccgttaaacggtttaaaccgttaacgggttaccgtaaacccggttaacggttaaccccgttttcggttacccggggttagggggaaccccgggggtttaccctaacggttttaccgtaaacgttaccgttaaccgtttaccgttaaccgttaaagggaaccggttaaacgtaaaacgtttaaccgggaaaaaccgttaaccggtaaccggtttaactttaacggttaacccgttaacggaaacccgtaaaagtaccggtaaaacccgtacggttacccgtaacgaaaccggttacgggtaacccggtaaacggg

SEQ ID NO: 148306 - DNA, 586 bp, Homo sapiens
  misc_feature: GYAE6OF01EWSJA.40.83.H06.1.454.CMB.1.raw
  modified_base (326)..(326): a, c, t, g, unknown or other
  misc_feature (326)..(326): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (409)..(409): a, c, t, g, unknown or other
  misc_feature (409)..(409): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggaggtcactgagactctcctgtgcatcggtccgattccaccttccataaatntaacntgcacgtgggtcccncaggcctccgaggcaagggctgcagtcggctggccacgtgtcgtggtacggatagtaaagttntgactaatactatgactagacttcgtcgtggacggggtcctaattccatcctatcttacgtaagaacgaactaagttaccggaaaacgtaaaccgtaccggtactttactaccgttaggaaccctaaaagtacgaaactaccgtacccgttagaaccgtacgggtaccggaaacggg

SEQ ID NO: 148307 - DNA, 555 bp, Homo sapiens
  misc_feature: GYAE6OF01ERHZR.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgacccaaggagcagcttggctgcagcagtaccagggcccgccctacccgaaactccctcctcccacgacggtctggccgacccggccctcgacggactctacgagagagatattctgcatccgaggttcgacgaacacacgtccctccctgaccactcacgtcggacctacgaacgtccgtagacggacgacggctagacttattactgttacagtctagtcgggacgacagcctagagtagtaggtgggtaggttcgggacggaacggtaacctaaacgtcgtacccggttacgtacggtccgcggtaacccgg

SEQ ID NO: 148308 - DNA, 523 bp, Homo sapiens
  misc_feature: GYAE6OF01BL4BR.40.83.H06.1.454.CMB.1.raw
  modified_base (457)..(457): a, c, t, g, unknown or other
  misc_feature (457)..(457): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactccctctcccacacggtctcggccgacccggccctcgacgggactctcagagagatattctgcatccgaggttcgacgaacacacgccctccctgaccatcactcgactacacgcctgacgacgacggctcgactagttactgtcagtcagtgggacgcgacgcctanaggtagagtgggtgtcgggcggacggaccgtaacgtcgtacccgtacgtacggtccgagtacccgg

SEQ ID NO: 148309 - DNA, 767 bp, Homo sapiens
  misc_feature: GYAE6OF01BQIV6.40.83.H06.1.454.CMB.1.raw
  modified_base (380)..(380): a, c, t, g, unknown or other
  misc_feature (380)..(380): n is a, c, g, or t
  modified_base (712)..(712): a, c, t, g, unknown or other
  misc_feature (712)..(712): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccagtggagtttgggctgagtcgttgggttttcctcgttgtcgttacgttttaaggaggttcgtccgtaaggttgtcgagggtgtacgtaggttgggtggtaggtcggtggggggagtcggtggtccaggccgtagggcgtcacgtgagtactcgtccgtgtgctagtccgtaccggtatttccgaccttcaaattaaatactaaacnttcggacctacggtcgggtacccgaccgacggtcctacccgaagggccgtaaaacggggtcctgggaccgtaacgggttcgggaccgtacggggaccctaacggtttcgggtaccggttacggggtaccgggttaaagttaacgggtaaaacgttttacgacggtaaccttaaacgttaaccgtttaagcgtaaccgtaacgttaacccgtttcgtaccgggtaggggtaaccggggtacccttaaggtttccaacgtttcctaacgttccgtaacgtaggttaaccgaacgttaagttaccggaaacgtaaccgtacggttacttacgtanacggtaactaaacgtcgaaaccgtcgtacccgtagaacgtcgggtacgtaacggg

SEQ ID NO: 148310 - DNA, 584 bp, Homo sapiens
  misc_feature: GYAE6OF01CUIHJ.40.83.H06.1.454.CMB.1.raw
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (420)..(420): a, c, t, g, unknown or other
  misc_feature (420)..(420): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcaggtgctaggttggtggagtcgtggggggagcgtggtccagcctgggagtcactgagtctctcctgtgcatccgtcgattcaccttcataaatataacntgcacgtgggtcccnccaggcctaccgagggccaaggggcctggcaggtcggctcggcctacgtgtcgtgggtcgatagtaaagttntgactatactatgacagtctcgtcgtggacgggtcctattcattctattcctagtaagacgtactaaagttaccggaaagtaaccgtacgggttactttaactcgtacgtaaaccaaagttacgaaactacgtacccgtagaaccgtagggtaccggaaacggg

SEQ ID NO: 148311 - DNA, 663 bp, Homo sapiens
  misc_feature: GYAE6OF01BR5NY.40.83.H06.1.454.CMB.1.raw
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatgggagtttgggctgagcttgggttttcctcgttgcttcttttaagaggtgtccagtgtcaggtgctagttgggtggagtcggtggggggagcgtggtccagccgtgggagtcactgagactctccgtgtgctatccggtccggtattccaccttcaataaatactaacatcgctacgtcgggtcccgccgacggtcctaccgacgggacgaagggcctggacgtagggtcgaccgtcggccctacgttggttccgtagggtacggtagtaagtaaagtttgacgtactaacgttactacgtcgaccgtacgtaccgttcgtacggtacgggaccgggtcctaagttccacttacctacgtaccgttacgtaagacgtaaccgtaaagtaccggaaaacgtaccgtaaccggttacgttactaccgtaacgtaacgtaaactacgaaccgtacgtaccgtaagaaccggtacggtacggtaacccgg

SEQ ID NO: 148312 - DNA, 597 bp, Homo sapiens
  misc_feature: GYAE6OF01CTAVR.40.83.H06.1.454.CMB.1.raw
  modified_base (353)..(353): a, c, t, g, unknown or other
  misc_feature (353)..(353): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcacgccaccctcggtgtccaaggacttgggacagaccgccacactcacctgcactgggaacagcgacatgtgcgcccaaggagcagcttggctgcagcagtaccgagggcccgccctacccaaacctccctccgtacccacacggtcctcggccgacccggcctcgaggactctcagagagatattcngcacgtaccgaggttccgacgaaacacgacggtccccttccctacgacccaactacctactacggaactccgaacgtccgtagacgggacgacggtctacggtaacttagttactgtacgagtctagggtacggaccggacacgtccgacgtaggtaggtacggttgggttcggtacgggtcgggaacgggtaaacccgtaacgtcggttacccggtacgtaacggtccgacggtaaccccggg

SEQ ID NO: 148313 - DNA, 699 bp, Homo sapiens
  misc_feature: GYAE6OF01APRMH.40.83.H06.1.454.CMB.1.raw
  modified_base (384)..(384): a, c, t, g, unknown or other
  misc_feature (384)..(384): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctggagtcttggggttttcctcgttgtcttcttttaagaggttgtccaggtgtcgaggtgcgtaggttgggtggtagtcggtggggggagcggtggtccaggccgtgggacgtcacgtgacgactccgtccgtgtcgctacgtccggtccgtattccaccttaccaataaatactaacatcgacacgttcgggcccnccgacggtcctaccgacgggacgaaacggggtctcggcgtagggtcggcctacgggaccctacgttcggttaccgtcggggtacgtaagttagggtaaacgtttgtacggtactaacgttacgtagtcgactacgtccgttacgtacggtacgggacggggtaccttacgttcattccgtagttccgtacgttaacgacgtaactaacgttaccggaaacaaccggtacggttaacttacgttactaacgtaaccgaaaagttccggaaacgtaccggtaaccgtacgtaaacggtacggtacccgggtaaccgg

SEQ ID NO: 148314 - DNA, 714 bp, Homo sapiens
  misc_feature: GYAE6OF01EHC8O.40.83.H06.1.454.CMB.1.raw
tcagtctagcgactcacgaccggtgctcgatttagatcacgtgcgtcgcggggtccgcggggcctggcccttttcggtttggagtattggttttctcgtagtggggtctgggagaggagcccagcactcgaagtcggcggtgttgccgagttcggtgatcgagtcgtactgaacacagtaaggactcacagtggagtttggctgagtcgttgggttttcctggttgcttgttttaaggacggtctcagtgtcaggtgctagtggtagacgtcgtggggagcgtgtcgagcgtggagtcacgtgacgactcgtccgtaggtacgtcgtagtcggtccggtacgttccaaccgttacctaataaacttaacgtaacgtagtcgacctgaaacccttggggttaccgccctaacgggacgtcccgtaaggggacctaacggggacttacggctacgtacgggccttaggccgtacgtaggttaccgtaaggttacgggaaattcggtaaaggtttaacttacggtaactagtaaacgtagtacgtacgtagtacgtacggacgttacggtacgggtccgtaagtttaccatttccgtaagttacgtaacgtaacgtaacgtaacgaaattaccggaaacgtaacgtacggttcgttaacgtacgtacgacgtaaaactcggtaacctaaggacccgttaggtaaccgtaggtaccgg

SEQ ID NO: 148315 - DNA, 597 bp, Homo sapiens
  misc_feature: GYAE6OF01AXNMW.40.83.H06.1.454.CMB.1.raw
  modified_base (356)..(356): a, c, t, g, unknown or other
  misc_feature (356)..(356): n is a, c, g, or t
  modified_base (428)..(428): a, c, t, g, unknown or other
  misc_feature (428)..(428): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtgcagttggtggagtcgtgggggagcgtggtccaggccgtgggagtcacgtgagactctccgtgtgcagtccgtccggtattccaccttccaataaatataacatcgctacgtgggtccncaggcctacgaggcaagggctcggcgtaggtcggctcggcctacgttgtcgtggtcggtagtggtaaagttntagactaatacgtatcgactacgtaccttcgtacgtaggacgggtcctacgttctactcgtattccgtacgtaagaactactaacgttaacgaaagtaaccgtacggtacttacgttactacgaactaaagtacgaacgtacgacgtagaacgtaggtaccggaaacgg

SEQ ID NO: 148316 - DNA, 682 bp, Homo sapiens
  misc_feature: GYAE6OF01EIFT6.40.83.H06.1.454.CMB.1.raw
  modified_base (519)..(519): a, c, t, g, unknown or other
  misc_feature (519)..(519): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagagactcacatggagttgggctgagtcgttgggttttcctcgttgcttacgttttaaggaggttgtccaggttgtcagggtgcgtaggtttgggtgggtaggttcggtgggggggacggtcggttcgggtacccgaggtcccggtaggggaacgtccaacgttggaacgtaccttccgtccgtggtcgacctagttccggtccggtattccctaccctttaccaaattaaataactaacagtcgacctacggtccgggcccaccgtacggtcctaccgaagggaccaaaggggtctggactagggtcgaccgtcggcctacgttggtcgtagggtacggtaagttacggtaaagttntagtactataacgtatcgactacgacttcgtaggtcgggacgggtacctacttctaactcctattaccgtactaaggtacaactaaggtaaccgaaacgaccgtaacgttcgttatacagtaacaacgtagaacgtacgaccttaggaccgtaggacggaacg

SEQ ID NO: 148317 - DNA, 779 bp, Homo sapiens
  misc_feature: GYAE6OF01DPIID.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggcgcagcttggctgacagcacgtacccgacgggcccaccctacccaaaccttccctacctccctaagtacggtccgtcgggcccgaccccggtcccctacgacgggtactccgtacgaaggaagacgtagttactttcgagaccgtacttacccgtaggtttccgaaccggtaaaccaccgaaccggtcccccttaccccgtaccgtaacccctaacgttaccccgtaccgttacgggaacccttcccgaaaaccgggttcccgttaaggggaacccgggtaaccgggtaacgggtaccgttacggtaaacctttaagtttacccgtttaggttacccgtaacgggtacgtaacgggttacgggggaacccggtaccggtaccggtaccccgttaacggtagggtaacggtaaagggtttcgggggtttaccgggttaccggggggaaccggggtaaaccgggtaacccgttaaaccggttcccgggttacccggtacccggttaacgggtcccgaccggtaaacccccggg

SEQ ID NO: 148318 - DNA, 718 bp, Homo sapiens
  misc_feature: GYAE6OF01ESJN3.40.83.H06.1.454.CMB.1.raw
  modified_base (377)..(377): a, c, t, g, unknown or other
  misc_feature (377)..(377): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagtcgttgggttttcctcgttgtcttcttttaaaggaggttcgtccagttgtcgaggtgctaggttgggtggaggtcggtggggggaggcggttcggtccaggtccgtggggacggtccacgtgacgtactctccgtgtgctagttccggtccggtattccgacctttaccaaattaaatactaacntgacctacgtcgggtcccacgaggtcctacgaggacgaagggtactggacgtaggtcggcctggccctagtcggtcgttgggtacgtaataggtaaacgttgcgtactaagttacgtagtcgaccgtaacgtaccgttcgtacggtacggggaccgggtaccttagttacctaagttcctagtttccctaacggttaaagtaacgtaactaacgtttaaccgggaaaaccgttaaacccggtacgttacctttttacgtaaccgaacggtaaaacctaaaggtaaccgaaaccgtacggttacccgtaagtaaaccgggttaaccggaccgggtaaacggg

SEQ ID NO: 148319 - DNA, 663 bp, Homo sapiens
  misc_feature: GYAE6OF01C39Y8.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttgggttttcctcgttgcttcttttaagaggtgtccagtgtcaggtgctaggttggtggagtcggtggggggaggtcgtggtccaggccgtggggaggtcacgtgacgtactctcctgtgcagtccgtccggactttccacccttaccaattaaaatactaaaccatgactaccggtcgggtcccaccgaggtcctaccgaagggaccgaaagggtctggaccgtaggtcggctcggccctacgtcgttcgtgggtacggtagttaaggtaaagttagtagtacgtaattaacgtagtcgacgtaacgtacctccgttacggtcgggtacggggtacccttagttacctaacttactacttccgttacgtaagaacgtaactaaacgttacgaaacgtaccgtacggtacgttactacgacgtaactaaagtacgaacgtacgtacctaggacgtaggtacggaaacggg

SEQ ID NO: 148320 - DNA, 654 bp, Homo sapiens
  misc_feature: GYAE6OF01C2QNU.40.83.H06.1.454.CMB.1.raw
  modified_base (367)..(367): a, c, t, g, unknown or other
  misc_feature (367)..(367): n is a, c, g, or t
tcagtctagcgactcacgaccggtgctcgatttagatcacgtgcgtcgcggggcccaaacagagcttcagcaagcatagtgggaatctgcaccatgccctgggctctgctcctcctgaccctctcactcactctgcagtgtcagtggtccaggcagggctgactcagccacctcggtgtccaaggacttgggacagaccgccacactcacctgcacgtgggaacagcgacaagtgtgcgcccaaggagcagcttggctgcagcacgtaccgacgggcccaccctcccgaaacctccctcctcccacgtaggtcctacggccgtacccggccctcgagggtactcgtcaagacgacgtagtacttccngtacacgttacccgtaggttccgacccgaaacgaccgaacctcccctacccgtacgacctaactccgaaccgtcggaacctcgaaacgtcccgttaggaacgggaccgagggtcttaacggaacttaacgtttaaccgtggttaccaggaccgtaggtacgggaaccggtcaccggttccgtacgacggttaggtaaacggttcggggtagttccggggacgggaacgggtaacccgttaaacggtccggttacccggtaccgtagggttcccgagggtacccccgg

SEQ ID NO: 148321 - DNA, 615 bp, Homo sapiens
  misc_feature: GYAE6OF01CK5UK.40.83.H06.1.454.CMB.1.raw
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccagttcggtgatcagcactgaacacagagactcacatggagtttggctgagtcgttgggttttcctcgttgtcttacgttttaaggaggtcgtcctagtgtcgaggtgctaggttggtggagtcggtgggggagtcgtggtccagccgtgggagtcacgtgagctctctgtgcagtccgtccgattccaaccttacaataaactataacntgacacgtcgggccncgagcctacgaggacgaaggtctgcgaggtcgcgtcggacctagtggtcgtagggtacgtaagtaggtaaacgttnagactaataacgtagtcgacgtataccgtcgtacgngggacgggtaccttatactacttacgacttaccgtagtaacgaacgtaacgtaaacgttaacggaaaacgaaaccgtacggtacttaagtaccgtagaactaaagtaacgaacgtacgactagaacgaggtaggaaaccgg

SEQ ID NO: 148322 - DNA, 558 bp, Homo sapiens
  misc_feature: GYAE6OF01EZFFJ.40.83.H06.1.454.CMB.1.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (415)..(415): a, c, t, g, unknown or other
  misc_feature (415)..(415): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgctcttttaagaggtgtccagtgtcaggtgcagttggtggagtcgtgggggagcgtggtccagccgtggggagtcactgagactctcctgtgcatcgtccggattccaccttccaataaatataacntgcacgtgggtcccncaggctccgaggcaagggctggcaggtcggctggcctacgtgtcgtgggtacggatagaagttangactatactatcgacagactcgtcgtggacggggtcctattccatctattctactagacaactaattacgaaacgtaaaccgacggttacttagtctacgactaaagtacgaaacgtacgcctagacgtaggacggtaacggg

SEQ ID NO: 148323 - DNA, 221 bp, Homo sapiens
  misc_feature: GYAE6OF01D19OJ.40.83.H06.1.454.CMB.1.raw
  modified_base (211)..(221): a, c, t, g, unknown or other
  misc_feature (211)..(221): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccagtggagtttggctgagcgggctggcaaggcgcatagnnnnnnnnnnn

SEQ ID NO: 148324 - DNA, 827 bp, Homo sapiens
  misc_feature: GYAE6OF01B1L52.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcacgcccaccctcggtcgtccaaggtacgttgggacacggacccgccacacctccacctgaccacgtgggaacaggcgaacaagtggttcggccgacccgaagggacgcgaagtcgttcggctcggacgaggaccacggtaacccgacggggccccgaccccctaccccgaaaaccttcccctaccctccccgaaccgacggttccgtacgggcccggaacccccggtcccccgtacggaaccgggtaccttccgtacgaacgggaacgtaacggtaactttaacttcgtacggtacctacgttacccggtaacgggtttaccgaaccgaaacccgtaccgacccggtaccccgttccccgtaacggaacccctaacgttacccgtaaccggttacggaacccttaaccggaaccggtacccggtacgggaaccggtaaccgggacggttaccgttacgtaacctttacgtttaaccgtacgtttaccgacgtacgtagggttaccgggacgtaccgtacgtacccgtagtacggttaacggtacgggttcggggttcgggtaaccgggggtaccggaaccggggttaaaccccgtaacgggttacccgggttacccgggttaacccgggtaacgggtcccggaacccgggtaacccccggg

SEQ ID NO: 148325 - DNA, 557 bp, Homo sapiens
  misc_feature: GYAE6OF01CX7E4.40.83.H06.1.454.CMB.1.raw
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
  modified_base (543)..(543): a, c, t, g, unknown or other
  misc_feature (543)..(543): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttctttaaagaggtgtccagtgtcaggtgcagttggtggagtcgtgggggagcgtggtccaggcctgggaggtcacgtgagactctcctgtgcagtcgtccgattcaccttcataaanataantgcacgtcgggccnccaggctccgaggcgaaggctgcgagtggctggccacgtgtcgtggtcgattaggaagttngacatactntgcagtctntcgtaggacgggtacctattccattctactcctacgtagatactaaagttaccgaaaaggacctacggtacttagtccttagaaacaaagttacgaactacgaccgttagaaaccgnggtaacgaaacggg

SEQ ID NO: 148326 - DNA, 633 bp, Homo sapiens
  misc_feature: GYAE6OF01C9NH1.40.83.H06.1.454.CMB.1.raw
  modified_base (435)..(435): a, c, t, g, unknown or other
  misc_feature (435)..(435): n is a, c, g, or t
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggaggtttgggctgagtcgttgggttttcctcgttgtcttcttttaaaggaggtcgtccagttgtcgaggtgcgtaggttgggtggaggtcggtggggggaggcggtcggtccaggtcccgtggggacggtcacgtgacgtccttctcctggtacgtcgtacgtccggtccggtacttacctaccctttaccaaattaaactactaacatcgctacggtccgggtacccgccgtacggcctccgagggaccgaagggtcncggcgtaggtcgcgtacgcctagtcgtcgtaggtacggtattagaaaggttntagactattctancgctacgtctcggtcgtagggtacggctattcacttcactcgttcaagtacgaactagtacgaacgtaccgtacgtagttacgtcaggtaccaaacgtgaaccctagtaccgtaaggacaacgggtcgaacgg

SEQ ID NO: 148327 - DNA, 794 bp, Homo sapiens
  misc_feature: GYAE6OF01EPJXE.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctcgaccctcctcactcactctgcagtgtcaggtcggtccaggcagggctgactcacgcccacccgtcggtacgtaccgaaggtacgttcgggaacacgacccgccaaccacctccaccgtcgaccgacgtacgggaacaggacgaactaagtggtacggccgacccgaagggtacgacgacggtccgttcgggacctcggacgacggaccgtaacggtaaccccgggaccggggcccccgtacccccgtaaccctaaacccgttccccttaccccgttacccgtaacggttaccgggttaccgtcggggaccccggtaaccccggtccccgtacggtaacggggtacctccggtaaccgaacggaacgtaacgtaactttaacgttccggtacgacgtaccgtccgttaacgggttaccgacgaacctaccgtaccgcccctacctacgacctactccgaacgtacggtacctacgaacgtccggaaggtacggaacgccggtactaacggttacgttaacttttacggcggttaccacgggtactacgggtacggggaaccgtcgacggtccgtaacgtaggtacgggttagtcggggttacggaccggggacgggtaaacccgtaacctaccggttaccggtacccggtaaccgtagggtacccaccgggtacccgg

SEQ ID NO: 148328 - DNA, 739 bp, Homo sapiens
  misc_feature: GYAE6OF01BBUAZ.40.83.H06.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (352)..(352): a, c, t, g, unknown or other
  misc_feature (352)..(352): n is a, c, g, or t
tcagtctagcgactcacgaccggtgctcgatttagatcacgtgcgtcgcggggtccgcggggctgccctttggttttggagatggttttctcgatggggtctgggagaggagcccagcactcgaagtcggcggtgttgccattcgggtgatcagcactgaacacagaggactcaccatggagtttgggctgagcttgggtttcctcgttgccttcttttaagnggtgtccagtgtcaggtncagttggtggagtcgtgggggagcgtggtccagccgtgggagtcacgtgagtactctcctgtcgcagtccggtccggatttccaccctttaccaattaaaactactaaacntgactacgtgggtccccgctaacggcctaccgagggtaccaaagggggtacctggaccgtaggttcgggaccttcggggacccctacgttcggttaccggtcgggttacgggtagttaacggtaaaggtttactacggtaacctaacgtaaccgtttagacggaccgtaacggtaaccgtttcccgtacgggttacggggtacccgggggtacccgtaacgttaaccgtactacccgttaacttacccgttacgtaacggaaccgtaaccgttaaacgttaaccggaaaacgtaacccgtaccggttaccgttaacgtaccgtacggtaaactaaaccgtacgaaaccgtacggacccgtaggaaccgaacgttaccgggaaacggg

SEQ ID NO: 148329 - DNA, 561 bp, Homo sapiens
  misc_feature: GYAE6OF01C5L1B.40.83.H06.1.454.CMB.1.raw
  modified_base (220)..(220): a, c, t, g, unknown or other
  misc_feature (220)..(220): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagnggtgtccagtgtcaggtgcagttggtgagtcgtgggggagcgtggtccagcctgggagtcactgagactctctgtgcatcgtcgattcaccttcataaatntaacatgcacgtcgggtccnccaggcctccgaggccaaaggggctggcaggtggctggcctacgtgtctgggtcgagtagtaagttatgctatactagtgactagcctcgtcgtaggacggggcctatcatctatctactagacgactaagttacgaaacgtaaaccgacggttacttaacgtctacggaacaaacgtacgaaacctacggaccctaggaaccgaggttcggaaaccggg

SEQ ID NO: 148330 - DNA, 606 bp, Homo sapiens
  misc_feature: GYAE6OF01A1DR3.40.83.H06.1.454.CMB.1.raw
  modified_base (487)..(487): a, c, t, g, unknown or other
  misc_feature (487)..(487): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacacctcacctgcactgggaacagcgacaatgttggcgcccaaggagcagcttggctgcagcagtaccgacgggcccgcccgtacccaaaccgtccctcctcccacacggtactcggccgaccccggccctcgacgggactcgtacgagagacgtatacttcgtgactacgtccgtaggttaccgacgaacacgacgtccctaccctacgacctactcgtacgtcggacctacgaacgtccgtaggacgacgtacgctagtaccttacgttacgtcgttacgngtaccgtaggtcgggaccgcacggccctacgacgtacggtagtcggggttacgttcggggaccggtaacgggaccctaacggtccggttaccgtaccgtacggtccaccggtaccccgg

SEQ ID NO: 148331 - DNA, 654 bp, Homo sapiens
  misc_feature: GYAE6OF01CHFVG.40.83.H06.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtcccaaggacttgggacagaccgccacactcacctgcacgtggaacagcgacatgttggcgcccaaggagcagcttggctgcagcagtaccaggcccgccctcccaaactcccnctaccccganacggtctcggccgacccggccctacgacgggtactctaccgaaggacggaagtatttaacgttcctcggtacactcccgtaaggtttacccgcgaaaccacgtacgcccttccccgtagacccactcacgtacggaactcaaacgtcctaggaacggtacgacggacttagaacttaacgttacgttacgttaccgaacgtccgtaaggttaccggggaacgggcctaacggtccgttacgaacgggttagtaaacgggtttgggggtacggttacccggggacgggaacgggtaacccaaaccggtttccggtacccgttacccggtacgggttccaacgggtaccccg

SEQ ID NO: 148332 - DNA, 613 bp, Homo sapiens
  misc_feature: GYAE6OF01AVUEC.40.83.H06.1.454.CMB.1.raw
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttctttaagaggtgtccagtgtcaggtgcagttggtgagtcgtgggggagcgtggtccaggccgtggggacggtccacgttgacgtacttctcctgtgcagtccggtccggtattccaccctttccaataaatataaacntggctacgtcgggtcccnccgaggcctccgaaggcgaaagggctggactaggtcggtcgtcggacctagtcgtccgtggtcggaattaggtaaacgtttcgtagtactaattactagtagacctagtacctcgtcgtggacgggacctagtcactcactctacgtagacgtaactaacgttacgaaacgtacgtaaccggtcttacgtaccgtagaaccgtaaagtacgaaaccgtacgtaccacgaactggtaccgtaacgg

SEQ ID NO: 148333 - DNA, 589 bp, Homo sapiens
  misc_feature: GYAE6OF01A625F.40.83.H06.1.454.CMB.1.raw
  modified_base (323)..(323): a, c, t, g, unknown or other
  misc_feature (323)..(323): n is a, c, g, or t
  modified_base (379)..(379): a, c, t, g, unknown or other
  misc_feature (379)..(379): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (464)..(464): a, c, t, g, unknown or other
  misc_feature (464)..(464): n is a, c, g, or t
  modified_base (466)..(467): a, c, t, g, unknown or other
  misc_feature (466)..(467): n is a, c, g, or t
  modified_base (470)..(470): a, c, t, g, unknown or other
  misc_feature (470)..(470): n is a, c, g, or t
  modified_base (473)..(473): a, c, t, g, unknown or other
  misc_feature (473)..(473): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctgagtcttgggttttcctcgttgcttcgttttaaggagttgtcctaggttgtcagggtgcgtaggtttgggtgggagttcggtggggggagtcggtggtccaggccgtggggacgtcacgtgagtctctcctgtnctagtcggtccgtatccaccttacaattaaatataacagtgactacgtcggtcccncgacggcctacgacggacgaaggctgacgtaggtcggccgtcggcctacgttcgtcgtggtcggaatagtaaacgttnannatananncanctngtggacggctactctatctactctagtagaactactaacgtacgaaacgtaccgtacgtactagtactagacaaacgtacgaaacgtacgtacgaacgacgtaaggtcgggaacgg

SEQ ID NO: 148334 - DNA, 954 bp, Homo sapiens
  misc_feature: GYAE6OF01AES0G.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcgtttgggttttcctcggtttgctttacgtttttaaggacggttcgtcctaggttgtcgaggttgcgtaggttgggtgggtacggttcgggtggggggacggtcggttcgggtcccgtaacggtcccggttagggggtaacggttccaaccggttggaacgtaccgttccttccgttagggttcgacctaacggtttccgggttacccggtactttaccccgtaacccgtttacctaaaatttaaaaacttaaccgtaaacctacgttcggacccgtacggttccggggtacccccgaccgtaacgggtcccgttacccggaaggggtaaccggtaaaggggtaccttcgggaaccggtagggttccgggtacccgttacgggtaccccttaacggttcggttccggttaggggtaccggtaagttaagggttaaaacgtttcgtacggtaaccttaacgttaacgtttacgacggtaacccgttaacggtacccgtttaccggttacgggtacggggtaaccggggtaccctttaagttccgtaacgtttaccgtaacgttttacccgttaacggttaaaacggaaccgttaacgttaaaaccggtttaaccgggaaaaaccgttaaacccggtaacccggttttaccgtttaaactacccgggttaaacgaaaccgttaaaacggttaaacccgtaaccgtaaacccggttaccgttaaaccgggaacccgttaacggggtacccgggtaaaacccgggg

SEQ ID NO: 148335 - DNA, 676 bp, Homo sapiens
  misc_feature: GYAE6OF01CDL5P.40.83.H06.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (497)..(497): a, c, t, g, unknown or other
  misc_feature (497)..(497): n is a, c, g, or t
tcagtctagcgactcacgaccggtgctcgatttagatcacgtgcgtcgcgggtcgcggggctgccctttggttttggagatggttttctcgatggggtctgggagaggagcccagcactcgaagtcggcggtgttgccattcggtgatcagcactgaacacagaggactcaccatggagtttggctgagcttgggtttcctcgttgcttacttttaaggaggtcgtccagtgtcaggtgcgagttggnggagtcggtgggggagcgtggtccaggccgtgggacgtcagtgatctctccgtgngtactacgtccggtaccgtacttacctaaccttactaaattaaaataactaaactgtcggtacccgtaacgggttccgggacccgtaccgaaccggccgtaaccggagggaacggaacggtacgtcggacggtacgggtcggtcggtaccgaccgtgttcggtacgtcgggtacgtagtaaacgttaagttacncgtactaacttaccgtagcgtaaaccagtcccgtcgttaacgtacggggacggtaccttaagtcctaacgtctacttacgtagaacgttacgaacgttaacgtaacgaaacgtacgaccgttatccgtagaccgaaataagaaccgacgtaccgaccaaggtcgaaaggccgtaaacgg

SEQ ID NO: 148336 - DNA, 666 bp, Homo sapiens
  misc_feature: GYAE6OF01A5CQ7.40.83.H06.1.454.CMB.1.raw
  modified_base (222)..(222): a, c, t, g, unknown or other
  misc_feature (222)..(222): n is a, c, g, or t
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgttgcttcttttaagnggtgtccagtgtcaggtgctaggttggtggagtcggtggggggaggtcggtggtccaggccgtggggagtcactgacgtcctctcctgtcgctacgtccggtccgattccacctttcaattaaatataacatgctacgtgggtcccncgagctacgaggacgaagggcnggtcaggtcggcctcgggccctacgttcggttcgtcgggtacggtattaggtaaagttagtacgactaattaaccgtattcggactaacgtaccgtcgttaccggtagggacggggtacccgtattacgtaacgttacctacgttaccgttaccgtaacggtaacgtaacctaaaggttaaccggaaacgaaccgttaaccgggttacttacgtactacgaacgtaaagttacgaaaccgtacgacccgtaaggaaccgtggtacggaacccggg

SEQ ID NO: 148337 - DNA, 699 bp, Homo sapiens
  misc_feature: GYAE6OF01B6Z2R.40.83.H06.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (429)..(429): a, c, t, g, unknown or other
  misc_feature (429)..(429): n is a, c, g, or t
tcagtctagcgactcacgaccggtgctcgatttagatcacgtgcgtcgcggggtcgcggggctgccctttggtttggagatggttttctcgatggggtctggggagaggagcccagcactcgaagtcggcggtgttgccattcggtgatcagcactgaacacagaggactcaccatggagtttgggctgagctgggtttccncgttgctcttttaagnggtgtccagtgtcagggtgcaggttggtggagtcgtggggggagcggtggtccagccgttggggacgtcacgtgagactctcctgtgcagtcgtccggnttccacttccaattaacataacatgcacgtggtcccncgagtccacgaggacaagggactgcaggtcgactcggacctacgtcgtcgtcgggtacggatacggtaaagtttntcggactattaccgtatacgactaacggtacctaccgttacggtcgggtaaccgggggttacccgtagtttaaccgacgtttaccggtaacctttccgttaacgttaacgggaacgtaacgtaaaccgtttaacgggaaaaaccgtaccggttaacccgggtacgttttaaccgttacggttaacgaaaccgttaaaacgtaccggtaaacctacccgggttaccctaaagggtaaccccgggttacgggtacccggggtaaaaccgggg

SEQ ID NO: 148338 - DNA, 770 bp, Homo sapiens
  misc_feature: GYAE6OF01BQ93M.40.83.H06.1.454.CMB.1.raw
  modified_base (225)..(225): a, c, t, g, unknown or other
  misc_feature (225)..(225): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtntccagtgtcaggtgcaggttggtggagtcgtgggggagcgtggtccagccgtgggagtcactgagactctccgtgtcgctacgtccggtccggtattccgaccctttccaaattaaactactaaacagtcgacctacgttcgggtcccaccgacggcctaccggaagggacgaaacgggggtctcgggacgtaacgggttcggcccgttacgggccctaaccggtttgggttacccggttacggggttaccgggtaagtttaacggggtaaaacgtttacggtacggtaaccttaagtttaaaccgttaacgtacgaccgttaacggtaaccctttccggttacggtaccggggtaaccgggggtaccctttaacgtttaccgtaaattcccgtaacgtttacccggttaacgttaacggtaaacgttaaaccgtaaacggttttaccggaaaacggtaaaccgtaaccgggttacctttaacgtacgtaggaaacctaaaagtccgaaactaccggacctaggaaccgtaggtaccggaaacgg

SEQ ID NO: 148339 - DNA, 800 bp, Homo sapiens
  misc_feature: GYAE6OF01D4S8I.40.83.H06.1.454.CMB.1.raw
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagttgggctgagcttgggtttcctcgttgcttcgttttaagaggtgtaccagtgtcgaggtgctaggttgggtggagtcgtggggggagcgtcggtccagtccgtaggggacggtcacgttggaacgaccttccgtcctggtgcctaagtccggtccggtatttccgaaccctttaccaattaaaatactaaactagtcggacctaacggtcggggtccccgtaccgaacgggtccctacccggaagggtaccgaaacgggggtaaccttcgggaccgtaacggggttcgggacccgtttacgggaccccctaacggtttacgggttcccgggtttacgggttacccgggtaagttaaggggttaaaacggtttaacggttacggtaaccttaacgttaaaccgttaacgtacgggtaccgtaaccggtaacccttaccggttaccggtacggggaaccggggtcccgttaacgttaccgtacttacgtaacgttccgttacgtaagaacgtaacgtaagttaacgaaaacggtaacctaacgggtacgttaacgtacgtacgtaaacgtaaactacggaaaccgtacgtacccgtaggaacgtaacggtacgggaaaccggg

SEQ ID NO: 148340 - DNA, 878 bp, Homo sapiens
  misc_feature: GYAE6OF01CB9KQ.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcacgccaccctcggtcgtccgaaggacttgggacacgaccgccacactcacctgcacgtggaacagacgacaatgtcggcgaccgaaggagcagcttggctgcagacacggtaccgacgggcccgacccgtacccaaacctccctcctacccgacgtacggtccgtcgggccgacccggtcccgtacggacgggtaccttccgtaccgaaggaacgggtacgtaacgtttaacgtttccgtacgtacctaacgttacccggtacggggtttaccgaacccggtaaacccgtaaccgtaacccgtccccgttacccccgtaaccgtaaccccgtaacgttacccgtaaaccggttaccggaaacccgttaacccggaaaccgggtcccgttaaacggggaaccggggtaaaccgggtacggggtaccgttaacgggttaaacccttttaacgttttaacccgttacggttttaacccggaacggtaaccggtaacggggttaccggggggaacccggtaccgtaaccgggtcccgttaccggtaaacggggttaaccggggttaaacgggttttcggggggtttacccgggggttaacccggggggtaaccgggggtaaaccggggttaaaaccccgttaaccgggttacccggggtttaccccggttaacccggttaaccgggtaacccggtaacccgggtaaacccccgggg

SEQ ID NO: 148341 - DNA, 680 bp, Homo sapiens
  misc_feature: GYAE6OF01C4QHU.40.83.H06.1.454.CMB.1.raw
  modified_base (246)..(246): a, c, t, g, unknown or other
  misc_feature (246)..(246): n is a, c, g, or t
  modified_base (402)..(402): a, c, t, g, unknown or other
  misc_feature (402)..(402): n is a, c, g, or t
tcagtctagcgactcacgaccggtgctcgatttagatcacgtgcgtcgcggggtcgcggggctgccctttggttttggagattggttttctcgatgggggtctgggagaggagcccagcactcgaagtcggcggtgttgccattcggtgatcagcactgaacacagaggactcaccatggagtttgggctgagtcttgggttttcctcgttgcttacgttttaagaggttgtccagttgtcaggtnctaggttggtggagtcgtgggggagcgtggtccaggccgtggggacgtcacgtgacgtacctcttccgtgtgacctagttcccggtccggtactttccctaacccgtttaccaaatttaaaactacgttaaacagttcgacctacgtcgggtcccnccgaggcctccgaggccgaagggcctgccgaggtcggccgtaggccctattggttccgtgggtacggtagttaacggtaagtttgcgactaattaacgtagttcgactacgtacccttcgtacggtacgggacggggtcctacgtttcaacttacgtaccttcgttactaaggaaccgtaaactaacgttaccggaaacgtaaccgtccgttacttacgtcgtacggaactaaacgtacgaaacgtacggtacctaggacgtcgggacggtaaccggg

SEQ ID NO: 148342 - DNA, 622 bp, Homo sapiens
  misc_feature: GYAE6OF01BM19Q.40.83.H06.1.454.CMB.1.raw
  modified_base (370)..(370): a, c, t, g, unknown or other
  misc_feature (370)..(370): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctgagtcttgggttttcctcgttgcttacttttaaggaggtgtccagtgtcgaggtgcgtagttggtggagtcggtgggggagcgtggtccagccgtgggagtcacgtgacgactctcctgtcgctacgtcgtccggattccaccgtttacaataaatataacagtcgactacgtcgggtccncgacggcctaccgaggacgaacgggactcgacgtaggtcggctcggaccctagttcgttcgtagggtacgtagtaaggtaagttacgcgtactattaacgtatcgactaacgtctcgtcgtaggacgggtacctatcacttacattcgtactacgatactaagtaccgaagtaaccgtacggttacttaacgtacgtacgaacaaacgttcgaaaccgtacgtaccgtaaggacgtaggaccggtaaccggg

SEQ ID NO: 148343 - DNA, 652 bp, Homo sapiens
  misc_feature: GYAE6OF01CV08R.40.83.H06.1.454.CMB.1.raw
  modified_base (222)..(222): a, c, t, g, unknown or other
  misc_feature (222)..(222): n is a, c, g, or t
  modified_base (612)..(612): a, c, t, g, unknown or other
  misc_feature (612)..(612): n is a, c, g, or t
  modified_base (640)..(640): a, c, t, g, unknown or other
  misc_feature (640)..(640): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaaggnggttgtccagtgtcaggtgctaggttggtggagtcgtggggggagcgtggtccagccgtggggagtcacgtgagactctccgtgtgcagtccgtcggtacttcaccttcaataaatataacatgctacgtcgggtcccgaccgaggtcctaccgagggaccgtaaagggggccttgggacctaacgggtcgggccgttcgggccctaacgttcggtcgtggggttaccggtaagtaagggtaaaagtttagtcggtacctaagttaaccttagtcgaccgtacggaccttccgtaccggttacgggaacgggggcccttaagtttccaattcgtaacttcgtacgtaagacgtaactaacttacggaaacgaaccgtacggtacttacgntagacaagtacgaactacgctaagacgnggtacggaacgg

SEQ ID NO: 148344 - DNA, 699 bp, Homo sapiens
  misc_feature: GYAE6OF01CL9VR.40.83.H06.1.454.CMB.1.raw
  modified_base (381)..(381): a, c, t, g, unknown or other
  misc_feature (381)..(381): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttgggttttcctcgttgtcttacgttttaaggaggttgtccgaggttgtcgagggtgcgtaggttgggtggagtcggtggggggagtcggtggtccagccgtggggaggtcactgagactctccgtgtgctagtccgtccggattccgaccttaccaattaaatataacatcgcacgttcgggtcccncgacggcttaccaggggaccgaaaggggtactggacgtaggtcggacgtcggacccctagttcggtccgttacggggtacggaagttaggaaagttttacgacgtactaataacgttatacgtactaacgtaccttacgtaccgggtagggaccggggtacccttaacgttctaacgttacctaacgttccgtaacgtaacgaacgtaacctaaaggttaccgaaaacgtaacccggtaacgtacctttaacgtcgtaacgaacctaaaaggtacgaaaccgtcgtaccgtagaacgttaccgggacggtaaaccggg

SEQ ID NO: 148345 - DNA, 806 bp, Homo sapiens
  misc_feature: GYAE6OF01C497E.40.83.H06.1.454.CMB.1.raw
  modified_base (661)..(661): a, c, t, g, unknown or other
  misc_feature (661)..(661): n is a, c, g, or t
  modified_base (743)..(743): a, c, t, g, unknown or other
  misc_feature (743)..(743): n is a, c, g, or t
  modified_base (757)..(757): a, c, t, g, unknown or other
  misc_feature (757)..(757): n is a, c, g, or t
tcagtctagcgactcacgaccggtgctcgatttagatcacgtgcgtcgcggggtcgcggggctgccctttggtttggagatggttttctcgagtggggtctgggagaggacgcccagcactcgaagtcggcggtgtgcattcggtgatcagcactgaacacagagctcactagtggtagttgggctggacgtcgttcgggttttcctcgtttcgacttacgttttaaggagggttcgtacctaggtcggttcgtagggtgtcgtaggttggtaggtaggttcgggtggggggagtccgggttcggtaccgaggtcccggtaggggtacggttccgaacgttggaacggtccttcgttccgttaggtacggtcctaacgtttccggtaccggttacctttaccctaaccctttaccaaattaaacttaactaactaccgtaggtacccgtaacgtacccggggtcccgaccggtaacggtcctaaccggaacgggaccggaacggggtactacgggcgtaggggtacgtaccggtcggtaccctaggttcggttacgtacggggtaacggtaacgtaaggggttaacttagtaccgtactaacggttaactcgtacggactaacgtccgtactgggtacgggaacgggtcctttagtaaccncggttctaactccgtttaacggataaccgtaacgtaaactacccgggtaaataaaccccggtcgttacgtacgttacggaanaaacccggttaaanacccgggtaaacacccggtacgaggtaaacctggggaacgtaaaccggg

SEQ ID NO: 148346 - DNA, 674 bp, Homo sapiens
  misc_feature: GYAE6OF01COE04.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacacgaccgccacactcacctgcacgtgggaacagcgacaattggttcggcgacccgaaggcgacgagtcgttggctgcagctagaccagggcccaccctacccaaactccctacctaccgaactacggtcgtcggacccgacccggtccctacgagggtactcctacgaagaagagtactacttcgaggtactacgtaccggtaaggttccaacgaaccaacgaccggcccttaccgtacggaccactccgaacgttcggaacctaccgaaacgtcccgtaaggaacggaacggtacggtaccttaggtaacctttacgttaacctggttaccgagtaccgtaggtcgggaacggctaaccggcctacgtaggtacggtaagggtcggggttggttaccgggaccgggaaacggggtaacccctaacgggttccggttacccggtaccggtttaacggcccggtaaccgtaaccccggg

SEQ ID NO: 148347 - DNA, 644 bp, Homo sapiens
  misc_feature: GYAE6OF01BSU8R.40.83.H06.1.454.CMB.1.raw
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatgggagtttgggctgagcgttgggttttcctcgttgcttcttttaaggaggtgtccagtcgtcaggtgctagttggtggagtcgtgggggagcgtggtccagcctgggaggtcacgtggagactctcctgtgcagtcgtccggattccaccttccaataaatanaacatgcacgtgggtcccnccgaggcctaccgagggccgaaaggggctcgcgtaaggtcgggccttcggaccctacgtcggttcgttggggtccggaagttaggtaaaggtttgtacggacctaagttaccgtaagtcgactaaggtaccgtcttcgtacgggacggggtccgtaattcgattaccgacttctaccgttaagacgaacgtaactacggaaaacgaccgtaacggttctaagttcctaggtaacaaagttacgaaaccgtagtacccgtaggaaccctacgggtcgggtaaaccgg

SEQ ID NO: 148348 - DNA, 659 bp, Homo sapiens
  misc_feature: GYAE6OF01AQ1HY.40.83.H06.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (506)..(506): a, c, t, g, unknown or other
  misc_feature (506)..(506): n is a, c, g, or t
  modified_base (562)..(562): a, c, t, g, unknown or other
  misc_feature (562)..(562): n is a, c, g, or t
tcagtctagcgactcacgaccggtgctcgatttagatcacgtgcgtcgcggggtcgcggggctgccctttggttttggagattggttttctcgatggggtctgggagaggacgcccagcactcgagtcggcgtgttgccattcggtgatcagcactgaacacagagactcaccatggtagtttggctgagcgttgggttttcctcgttncttctttaagnggtctcagtgtcaggtgntaggtggtgggtacgtcggtaggggggagtcggtggtccaggtccgtaggggacggttcaacgtcggtaagacccttccgttcctggtaccgctacgttccggtacccggtatttcctaccctttacaaagtaactaagtaactagtcgtaccgtacgtcgggtcccaccgacggtcctacgaggacgtaaagggctagacgtcggtagccgttcggccctacgttcgtacggttcgggtaacgtagtaggttaaagttcgacgttanaacgttactacgcgactagtaccgtcgttaggtcgggacgggaccgtatttaccgntacgtacttactaacgtagaaccgtataacgttagacaccggtaactctagtcacgacttaaggacgtacgaccgtacacgtacgaggtccgaacgg

SEQ ID NO: 148349 - DNA, 766 bp, Homo sapiens
  misc_feature: GYAE6OF01B6YRW.40.83.H06.1.454.CMB.1.raw
  modified_base (266)..(266): a, c, t, g, unknown or other
  misc_feature (266)..(266): n is a, c, g, or t
tcagtctagcgactcacgaccggtgctcgatttagatcacgtgcgtcggcggggtccaaacagagcttcagcaagcatagtgggaatctgcaccatgccctgggctctgctcctcctcgacctctcactcactctgcagtgtcagtgccaggcagggctggactcgacgccacccgtggcgtaccgaaggcttacgggacacgaccgcacactcgacctgacacgtaggaacagcgactagtcggttacggccgaccgaagggacncgtaggtaccgttggcctagcgaacgtccgaacggtacccgacgggaccccgtacccctaccgaaaccttccctaccgaccgacggtaccggttccgtaccgggaccgtaccccggtacccgtacggacgggtaaccttccgtaacggacggtaaacgggacttacggtttactttaccggacgtaaccgtaccgtaccggtacggttaccgaacgtaaccgacgtacccggtacccgtacctaccggtactacgttacgacgttaccgtaacgacgtaacgtccgtacggaaccgggtacacggggttacacggtttaaaccttacgttacgtttaaccggtcgtacggtaacccggtagggtaccgggtaccgacgtaaccggttaccgaggtacgggttaacggacgggttcgggttacgggacgggaaccggttaacggtaaccgtaaccggttttcgggaccctacgggtttaagcccgggaacgtaccccgggg

SEQ ID NO: 148350 - DNA, 694 bp, Homo sapiens
  misc_feature: GYAE6OF01D3CCN.40.83.H06.1.454.CMB.1.raw
tcagtctagcgactcacgaccggtgctcgatttagatcacgtgcgtcgcggggtcgcggggctgccctttggtttggagattggttttctcgagtgggggtctgggagaggagcccagcactcgaagtcggcggtgttgcctagttcggtgatcagcactgaacacagaggactcaccagtgggtagtttgggctgagtcgtttgggttttcctcgttgtctttacgttttaaggaggttcgtaccagttcgtacgaggtgacgtaggttgggtaggtaggtcgggtaggggggacgtcggtcggtccgaggtccggtggggaacgtcacgtagaagtccttcgtccgtagtgcctagtccggtaccgtattcctacccttacaattaatataactgtacgaccgtacggtccgggtcccaccgaggtccctacggacgggacgtaaacgggtcctggacgtacgggtcgggtccgtcggacccttacggttcggtacgggttacgggtaccggtaagtaacggttaaagtttacgtacgtactaacgttactacgtcgaactcgtacttcgtacggtggtacgggcttactcgtaactcgtactcgtacagaactacgtaagtacgaaacgaccgtataccgtatacgagtaaacaagtcgaacgtcgtacgaacgtagacggtacgtaacgg

SEQ ID NO: 148351 - DNA, 628 bp, Homo sapiens
  misc_feature: GYAE6OF01E23QD.40.83.H06.1.454.CMB.1.raw
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcaggtgcaggttggtggagtcgtgggggagcgtggtccaggccgtgggagtcacgtgagctctcctgtgcagtccgtccggtattccacctttccaataaactataacntgctacgtcgggtcccncgaggcctcgaggcgaagggactggctaggtcggctcggccctagtcgtcgtgggtacgagtagtaaagttncgtactatactagtcgactacgtaccttcgtcggagggtaccggggtacctaagttcaactacctagtccgttacgtaagaacgtaactaaacgttaacggaaacgtaaaccgtacggttactttaacgtaccgtagtaaacctaaagtaaccgaactaccgtaccggtaagaaccggtaacggtacgggaaaccgg

SEQ ID NO: 148352 - DNA, 867 bp, Homo sapiens
  misc_feature: GYAE6OF01CPGUV.40.83.H06.1.454.CMB.1.raw
  modified_base (458)..(458): a, c, t, g, unknown or other
  misc_feature (458)..(458): n is a, c, g, or t
  modified_base (817)..(817): a, c, t, g, unknown or other
  misc_feature (817)..(817): n is a, c, g, or t
tcagtctagcgactcacgaccggtgctcgatttagatcacgtgcgtcgcggggtcgcggggctgccctttggttttggagattggttttctcgatggggtctgggagaggagcccagcactcgaagtcggcggtgttgccattcggtgatcagcactgaacacagaggactcaccatggagtttgggctgagtcgttgggttttcctcggttgtcttacgtttaagaggtgtcctagtgtcgtaggtgtcgtaggttgggtcggtaggtcggtggggggacggtcggttcgggtaccgtacggtccggttggggaacggttccaacgtcggacggtaccttccgttccgtggtcgaccgtacgtttccggttaccgttactttacctaaccctttacctaaaattaaaacttaacttaaaacgacgtttcggaccgtaaccggttcggggtaaccccnccgtaacgggtacccgtaccggaaacggggtaaccgaaacggggtaccttcggaccggtaacggttcgggcccgtttacggggacccctaacggttacgggttcccgggttaggggttaaccgtaagttaacggggttaaaacttttggacccggtaataaacgtttaccgtaaggttccaacgtaaccgtaccttccggttacgggaggggtaccggtaccctaactttacccgacgttcctaaacgtccttaacgtaaaggaccgttaaaccgttaagttaacccggaaacgtaaacccggtcggtttaaactttaacggttccaaacggtaaaccttaaaacgccgggtaaaaccncccgggttaaccgtaaaggtaacccggtaaggggtccccggaaaacgggg

SEQ ID NO: 148353 - DNA, 716 bp, Homo sapiens
  misc_feature: GYAE6OF01AVYEI.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctgagtcttgggttttcctcgttgtcttacgttttaaggaggtgtcctagttgtcgaggtgcgtaggttggtgggtaggtcggtgggggggacggtcggttcgggtccgaggtccggtggggtacggttccgacgtaggacgaccgttccgtcccgttggtcgtcgtacgttccggtccggttacttccctaccctttaccaaagttaaactaataaacgtactacgaccgtaccggttccggggtcccgccgaaccggtcgtacccggaacgggacggtaacgggcgtacggaccgtaggtcggtacgtccgggaccctcgttcgttcggtgggtacgtagtaagtaagttagtcgtactactacgttactcgactacgtacctcgtacggtcgggaccgggtactacgttctactcgaacttctacgtagaactaacgtaacgtaacgaaacgtaaccgacgtacttacgtagtaacgaactaacgtaagaacgtacgtaccgtaagaccggtagtaccgggaacgg

SEQ ID NO: 148354 - DNA, 736 bp, Homo sapiens
  misc_feature: GYAE6OF01EKP6B.40.83.H06.1.454.CMB.1.raw
  modified_base (245)..(245): a, c, t, g, unknown or other
  misc_feature (245)..(245): n is a, c, g, or t
  modified_base (625)..(625): a, c, t, g, unknown or other
  misc_feature (625)..(625): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctcgaccctctcactcactctgcagtgtcaggtcggtccaggcagggctgactcgacgcccgacccgtcggtcgtaccgaaggcgttaggggacacgaccgccacactccacctgacgacgtacgggaacngacgacaagttcggtcggccgaccaaaggacgcgacgtcgttgggactgcgacgcgtacggtaccgaccgggacccaccccgtaaccctaaaccgtcccgtacctacccgaacggtacggttccgtaccgggaccggtaccccggtacccgttacggacgggttacctccgtaacgacgggtaaaggaacgttaacttacgttttacgacgtacgttaaccgtacccggttaacgggttaaccgaccgtaaaccgtaccgtaacccggtcccctttaccgaacggtaacctaacctacccggtaacggtccgtaacaacggttacgacggtaacgggaacggagtaccggtactagtaccttaacgttcgttcggtaacncgtagacgggtacgacgccgtaccgtacggagtacgggtagtaccgggtgggttaccggtgggaacggaaccgaacgtacgtcggtacgtaccgcgtaccgcggtacccgg

SEQ ID NO: 148355 - DNA, 641 bp, Homo sapiens
  misc_feature: GYAE6OF01BR5KL.40.83.H06.1.454.CMB.1.raw
  modified_base (370)..(370): a, c, t, g, unknown or other
  misc_feature (370)..(370): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagcttgggttttcctcgttgcttctttttaaggaggttgtccagttgtcagggtgcgtaggtttgggtgggagtcggtggggggaggtcgtggtccaggccgtgggagtcacgtgagaccttctcctgtcgcagttccggtccggtacttcctacccgtttaccaaattaaactaataaacngtcgacgtacgttcgggtcccgaccgacggtcctaccgaggacgaagggactggacgtaggtcgaccgtcggacctacgtgtcggtcggtacgtagtacgtaaagttgtacgactatactagtacgcgtacgtcttcgtacgtggaccgggtctacttacgacttcctagttccgtagtaacgtacgtactaagttacgaaacgaaccgtacggttactactactagaaccgtaaagacgaacgtactcgtaagacgtaggtacggaacgg

SEQ ID NO: 148356 - DNA, 777 bp, Homo sapiens
  misc_feature: GYAE6OF01B91PV.40.83.H06.1.454.CMB.1.raw
tcagtctagcgactcacgaccggtgctcgatttagatcacgtgcgtcgcggggtcgcggggctgccctttggttttggagattggttttctcgatgggggtctgggagaggagcccagcactcgaagtcggcggtgttgccattcggtgatcagcactgaacacagaggactcacatggagtttgggctgagtcttgggttttcctcgttgcttcttttaagaggtgtccagtgtcgaggtgcgtaggttggtgggagttcggtggggggaggtcggtcggtccgaggtcccgtaggggacgtcacgtgacgtctctccgtgtgctacgtccggtaccgtacttccaaccctttaccaaattaaaatacttaaacagtcgtacctaccggtcgggtcccgaccgacgtccgtaaccgaagggactaaacggacgtacgtgtaccgtagggtcgggacctcgggaccctacgttcgttacgtagggttaccggtaagttaggtaaaagtttgtacgtaccgtaagttaaccttagtacgacgtaacgttacttcccggttacggtacggggtaaccggggtaccttaccgttacgtaacgttaccctacgtttaccgttaacggttaaacgaaccgtaaaccgttaaacgtttaaaccggaaaaccgggtaaaccgtaaccggtttaccgtttaaacgtacggtttaaacgaaaccgttaaaagttaacccgtaaacggaccgttacccgtaacgtaaccggtacgggtaaacccggg

SEQ ID NO: 148357 - DNA, 790 bp, Homo sapiens
  misc_feature: GYAE6OF01AI2F8.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtgtccaggcagggctgactcgacgccaccgtcggtacgtccaagggcttcgggaacacgacccgcctaaccaccgtaccaccttgacaaccgtaggggaaaccaggtaccgaactaagttcggttaccgggaccgacccgaagggacgcgtacgtcgttcggcgtcgacgagaccgaacgtaacccggacgggtccccgacccctacccgaaacccttccctacccgtacccgaacgttaccgggtccgtaccgggtacccgggtaaccccggtccccgtacggaaccgggttaccgtaccgtaccggtaacggtaacggaacggtactttaacgtttccgtacggtacctaccgttaacccggtacgggttaccgaaccgtaaccgaaccgtacccgtccccgttaacccctcgtaaccaccttaccaacgttcggaaccttacgaaccggacccttacgggacggaacgacggtcctaacgtacttaagttcgttacgttaacgacgtacgtacggtacggggaccgtacggacgtacccggtagtacggacggtttaacggtcggggttaacggttccggggaaccggaacgggtaaccgaacgttccgttacccggtaggtaccggtcgaacgtaacccggg

SEQ ID NO: 148358 - DNA, 879 bp, Homo sapiens
  misc_feature: GYAE6OF01AZAJC.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatgggtagttggctgagtcgttggtttcctcgttgtcttacgttttaaggaggttcgtccgtaggttgtacgaggtgtcgtaggttcgggtggtacggttcgggtggggggacggtccgggttcggtaccgtacggtccggttaggggtaccggttccgtacggttacggtaacgtacccttccgttccgttcggtcgtaccgtaccgtttccgggtacccggttactttacccgttaacccgtttactaaacgttaaaacttaaccgtaactacgtacgtaccgtaccggtacgggtaccccgacgtaccggtacccgtaccggtacggtaccggtaaacgggtccgtcggacggtacgggtcggtaccggtaccggtaccccgtacgttacgggttccgggttacgggtacggtaagttaaacgggttaagttcgtacggaacgtttaacgttaaacccgttaggtccgaacggttaaaccggtcctttccgggtcggtaacggggggtacccgggttaacccttaagtttccgtaacctccgttaagttcccgttaaggtaaacgggtaaccctaaacggttaagttaacccggaaagtaacccggttaccggttaacttttacccgaggtaaccgttaaacgaaccggttaccgaaaccggtccgtaccgtaacgggtaacgtccggtaaaccgggtaacg

SEQ ID NO: 148359 - DNA, 731 bp, Homo sapiens
  misc_feature: GYAE6OF01BHV5Y.40.83.H06.1.454.CMB.1.raw
  modified_base (362)..(362): a, c, t, g, unknown or other
  misc_feature (362)..(362): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcgaggtgctagttggtggagttcgtgggggacggtcgttcggtccaggccgtgggacggtcacgtgacgacttctccgtgtgctagttccgtccgtacttccaccctttaccaataaaacttataacgngtcgacaccgttcggtcccgccgacggtcctaccgaggtaccggaagggtactcggacgtaacgggtcggacccgttacgggcccttaaacgttcgggtaccgttacggggttaccgggtaagttaacgggtaaaacgttttacgtacgtacttaacgttaaccgttagtacgactacgtaccttacgttaccggttaacgggtaccggggtacccgttaacttaccgttaaccgttacgtaacgtttcccgttaaccgttaaacggtaaccgtaaaccttaaagttaccggaaaaccgtaacgtaaccggttacgttacgttcgtagacctaaatacggaactcgactacgaacgaggtaccgaacgg

SEQ ID NO: 148360 - DNA, 905 bp, Homo sapiens
  misc_feature: GYAE6OF01BLABU.40.83.H06.1.454.CMB.1.raw
  modified_base (232)..(232): a, c, t, g, unknown or other
  misc_feature (232)..(232): n is a, c, g, or t
tcagtctagcgactcacgaccggtgctcgatttagatcacgtgcgtcgcgggtcgcggggctgccctttggtttggagattggttttctcgagtggggtctgggagaggagcccagcactcgaagtcggcggtgttgcctagttcggtgatcagcactgaacacagagactcaccagtggtagtttggctgagtcgttcgggttttcctcgttgtcctttacgttttaaggnggttcgtaccgtaggttcgtcgaggtgacgtaggttggtggaggttcgggtggggggacgtccggttcggtacccgaggtcccggttaggggtacggttaccacgttggtaacgtcccgttcgttccgtaggtcgtctacgttccggtaccggttaccttaccctacccgtttacctaaaattaaataacctaaccgattcggaccgttaccggtccgggtcccgaccgacggtcctacggacgggtaacgtaacgggcttggaccgtagggtcggtaccgtcggtacccgtacgtttcggttaccggttagggtacggttaagttaaacgggttaaacgtttacgtaccggtaacttaacgttaaccttaacggtacgttaccggttaaaccgttacccgttttacggtaccgggttacggggtaacccggggttaaccttaacgttaacccgttaacgttaccgttaaaccgttcggtttaaaccgtaaacgggtaaaccgttaaacccgttaaacggttaaaccgggaaaacccgtaaacccggttaaccgggtttacctttaaacggtttaacccgaaccggttaaaacgaaaccgttaacccggtaaaccggtaacccgttacccgaaacgggtttaaacgggacgggttaaccccgggtaaaaccgg

SEQ ID NO: 148361 - DNA, 757 bp, Homo sapiens
  misc_feature: GYAE6OF01CXOUB.40.83.H06.1.454.CMB.1.raw
  modified_base (178)..(178): a, c, t, g, unknown or other
  misc_feature (178)..(178): n is a, c, g, or t
tcagtctagcgactcacgaccggtgctcgatttagatcacgtgcgtcggcggggtcgcggggctgccctttggttttggagatggttttctcgatggggtctgggagaggagcccagcactcgaagtcggcggtgttgccattcggtgatcagcactgaacacagagactcacatggngttgggctgagtcttgggttttcctcgttgcttcgtttaaggaggtgtccgagttcgtcgaggttcgcgtaggtttgggtaggacggttccggtagggggggacgtccggttcggtcccaggtcccgtagggggacgttcacgtggacgtaccttccgtaccgtgtcgactacgttccggtccggtactttcccaaccctttaccaattaaaactacgtaaacctagttcgacgtaccggttcgggtcccgaccgtagggccctacccgggaaggacccggaaagggtcctacggacgtagggtcgggtcctcggaccctacggtcgttccggtagggtaccggtaagttaacggtaaagtttagacggtaactaagtttaacgtagtacgacctaacggttaccttccggttacggtaaggggacccggggttaaccttacgttaaccgtactttacctagttaccgtacgttaaagtaagtaacgtaacgtaaccggtaaacgtaaccgtaccggttacttaacgtcgtaacgaactaaacgtacgaacgtcgtacgtagaacgtcggtacgaacgg

SEQ ID NO: 148362 - DNA, 767 bp, Homo sapiens
  misc_feature: GYAE6OF01CDP2W.40.83.H06.1.454.CMB.1.raw
  modified_base (233)..(233): a, c, t, g, unknown or other
  misc_feature (233)..(233): n is a, c, g, or t
tcagtctagcgactcacgaccggtgctcgatttagatcacgtgcgtcgcggggtcgcgggctgccctttggtttggagattggttttctcgagtggggtctgggagaggagcccagcactcgaaggtcggcggtgttcgcctagttcggtgatcagcactagaacacgagacgactcactgtggtagttggctgacgtcgtttcggtttcctcgttagtcttacgtttaaggngtcgtcgtagtgtcgtaggtcgacgttagggttgggtaggtacggtcgggtagggggcggtccggtcggtcccgacggtccggtacggggtaggtaccgtacggttacgacgttacctccgtccgtagtcggtccgtacgtccggttccggtacttccgttaacccttacctaaaataaactaactaacctgtccgtacgtacggtcggtacccgtaccgacggtaccgtacggacggaacggtaacgggtcacggtcgtacggtcgcgtcgaccgtcgtacggtcggtacggtagtaagttaggttaagtcgtacggtacttaacgtactacggtacgtcgtactaccgtttgaccgggttagggtacccgggttacttaacctcgtaacgttacctaacggttacgtaaacgaacgggttaactaaacgttaacgtaaacgggaaacgttaccgttaaccgtacgttacctagtaaacgtaacgtaagaacccgtacgtaacgacgttacgaaaccgtcgaacggtaaccgg

SEQ ID NO: 148363 - DNA, 601 bp, Homo sapiens
  misc_feature: GYAE6OF01DJW31.40.83.H06.1.454.CMB.1.raw
  modified_base (333)..(333): a, c, t, g, unknown or other
  misc_feature (333)..(333): n is a, c, g, or t
  modified_base (500)..(500): a, c, t, g, unknown or other
  misc_feature (500)..(500): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtgtccaggcaggctgactcacgccctaccctcggtcgtaccgaaggtacttggggacacggtacccgccacacctccaccctgaccacgtgggaacagtcgactaagttggtcggaccgcccgaaggacgcagcgttggctgcagacacgtaccgaggccccgcctacccaactcctccacccgacgngtcgtcggccgacccgccctcgacggactctacgagagacagttactctagcacgttacaggttacacgaactacacgccctacccacgacactaccacgtacggactaccgagtccgtacggacgacgcgtacgtacgtacttacgttaacttcgttacgtacgtntaggtcgggacgtccgagtccctcgagtgtaaggttcgggtacggtacgggacggtaacggaccgtaacgtcggtcccgtaacgtcggccgtcgacccggg

SEQ ID NO: 148364 - DNA, 681 bp, Homo sapiens
  misc_feature: GYAE6OF01CH5AV.40.83.H06.1.454.CMB.1.raw
  modified_base (373)..(373): a, c, t, g, unknown or other
  misc_feature (373)..(373): n is a, c, g, or t
  modified_base (434)..(434): a, c, t, g, unknown or other
  misc_feature (434)..(434): n is a, c, g, or t
  modified_base (476)..(476): a, c, t, g, unknown or other
  misc_feature (476)..(476): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagagactcaccatggagtttgggctgagtcgttgggttttcctcgttgtcttacgttttaaggaggtgtcctagtgtcgtaggtgctaggttggtcgggagtcggtggggggagtcggtggtccaggccgtggggacgtcacgtagagacctcctcgtgtgaccgtagtccggtaccggtattccctaccttaccaattaaatactaaactntagaccgacgtcgggtcccaccgtagcctacgaggaccgaagggctggacctaggtcggcncggccctagtcggtgtcgggtacgtagtaagtaacgttacgngtacctattaactagtcgtactacggtaccgtcgttacggtagggtaccgggtacctacttacctaagttccacttaccgtagtaaccgtagtaacctaagtaccgaaagtaaccgtaccggtttacttacgtacgttaacaaccggttaaactacggaaaccgtacggtaccccgtagaaccggtagggtaccgtaaacccggg

SEQ ID NO: 148365 - DNA, 861 bp, Homo sapiens
  misc_feature: GYAE6OF01AGPAP.40.83.H06.1.454.CMB.1.raw
  modified_base (228)..(228): a, c, t, g, unknown or other
  misc_feature (228)..(228): n is a, c, g, or t
tcagtctagcgactcacgaccggtgctcgatttagatcacgtgcgtcgcggggtcgcggggctgccctttggtttggagatggttttctcgatgggtcgtgggagaggagcccagcactcgaagtcggcggtgttgccagttcggtgatcagcactgaacacagagactcaccatggtagttgggctggagtcgttgggttttacctggttgctttcgttttaaaggnggttgtccgtagtcgttacgtagggttgcgtaggtttgggtagggacggttcggtgggggggacgtcgggtcgggttacccaggtccggtaggggtacggtccgtaaccgtggtacgtacccgttccggttcgttacggtccggacgtaccggtttccggggtaccccggttaagtttccccctaacccgtttaaccggtaaatttaaaaacttaaccgttaaaaaccgtgttaaccggtacccgttaaccgggttaccggggttcccccaacggaaaccggggttccccttaccgggaaagggacccggtaaaacggggtacccgttacggaccggtaacgggttcgggcccgtttggaccccgtacggtttcgggttaccggtcgggttacgggtaagttacgggttaacggttataccgacgttaacgttagttacgtgtacgtaaccgtacctttcgtaccggtaggtaccgggtacctacgtttccgatccttacgttacctaccgtaaggtaacctacggtaacgttaaccggaaggtaacccgttacggtaccgttacgtaacgtacgtaaacgtaacgttaccgaaacgtccgttaacgaacgtaccggtaacgcggtaaaccgg

SEQ ID NO: 148366 - DNA, 732 bp, Homo sapiens
  misc_feature: GYAE6OF01BLXU4.40.83.H06.1.454.CMB.1.raw
  modified_base (225)..(225): a, c, t, g, unknown or other
  misc_feature (225)..(225): n is a, c, g, or t
  modified_base (549)..(549): a, c, t, g, unknown or other
  misc_feature (549)..(549): n is a, c, g, or t
  modified_base (614)..(614): a, c, t, g, unknown or other
  misc_feature (614)..(614): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatgggagtttgggctgagtcgttgggtttcctcgttgtcttcgttttaaggnggttgtccagttgtcgagggttcgcgtaggtttcgggtaggtaggttccggtagggggggacgtcggttcggtccgaacggtcccggttaggggacgtcctacgtgtacgtacttcctccgttgtcgactacgttccggtccggtacttccctaaccgttaccaaacttaaactacgtaaactaggttccgaccgtaacggtccgggttacccgaccggtacgtccgtaaccggacgggaccggtaaggggcctacggcggtaagggtccgcgtccggtacctacggtcgttccggtgggtacggtagttaagggtaacgttancggtaactacgtaactagcgaagtacgtctacgtcgacgggcgggttctacttaacgtcttaacncgttacgtacgtaacgtaggtaactaacggttaacgaaacgtccggtaccttagtccgttaaggactaacggtaaaactacggaactcgtaccgtaagcgtaaacgtcgggtaaaccg

SEQ ID NO: 148367 - DNA, 841 bp, Homo sapiens
  misc_feature: GYAE6OF01CTT8N.40.83.H06.1.454.CMB.1.raw
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccagtggagtttgggctgagtcgttcgggttttcctcgttgcttcttttaaggaggttcgtcctagttgtcgaggtgcgtaggttggtggtaggtcggtgggggaggtcggtggtccgaggccgtgggagtcacgtggacgctcgtccgtggtcgctacgttccggtaccggtctttaccgtaccctttaccaaatttaaaactaactaaacctaacgtcggtaccgtaccggtccggggtacccgaccgtacggtcccgttaccggaaggggaaccggtaaacggggtaccttcgggaccgtaacggggttccgggtccggtaccggggtacccttaacggttccgggttaccggttacggggtaacgggtaacgttaacgggttaaacgtttacggtacgtaaccgttaacgttaaccgttgtaccgacgtaacggtaccttacccggttcgggttaacggggacccggggttaccgttacgtttacctaacgttacccgttacgttaccgttaacgtaacggtaaccgttaactaaacggttaaccggtaaaacgaaacccggttaacgggtaccttttaacgaccgttaacggtaaacgtaaacggtaaaccgtaccgtaaccggttaacggaacggtacggtaaccggggaaggttaacccgg

SEQ ID NO: 148368 - DNA, 882 bp, Homo sapiens
  misc_feature: GYAE6OF01DHU3D.40.83.H06.1.454.CMB.1.raw
tcagtctagcgactcacgaccggtgctcgatttagatcacgtgcgtcgcggggtccaaaacagagcttcagcgaagcatagtgggaatcctgcaccatgccctgggactctgctcctcctgaccctcctcactcactctgcagtgtcagtggtccaggccagggctgactcacgccctacccgtcggtcgtacccgaaggacgttggggaccacggacccgacccaaccaccttaccaacccgtcgaccgtaaccgtacggggaaaccaacggaccgaaaccgtaaagttcggggtttacgggacccggaccccgaaagggacggaccgtacggtcgtttcggcctggaccgacggacctaacggtaccccggaccgggggtacccccgtaaccccctaccccgtaaacccttccccttaccccgtaccccgtacggaccggttcccggtaccgggacccggtacccccggtaccccgttccggaaacgggtaccttaccgtaaccgaagggtaaacgtaacggttactttaacctttccgtacgtaacccgttacgttacccggtaacgggtttacccgaacccgtaaaccgtaccgacccgttacccccgttacccgtaccggtaacccctacgtaccctacggtaaccgtacgtacccggaacgtccgtaggaacggacgtacggtctacgtacgtttactgtacgttacgagtacgtaggtcggaaccggtctacggtaccctagtacgggttacgtaacgggggttcggttaccggggtaacgggggtacccgggtaaacgggtaaccccggtaaacggtttcccggttaaccccggttccggtaaccgggtacccggtccccggtaaaccccgggg

SEQ ID NO: 148369 - DNA, 564 bp, Homo sapiens
  misc_feature: GYAE6OF01DOPI4.40.83.H06.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
  modified_base (550)..(550): a, c, t, g, unknown or other
  misc_feature (550)..(550): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgttgcttcttttaagnggtgtccagtgtcaggtncagttggnggagtcgnggggggagcgtggtccagccgtgggagtcactgagactctctgtgcatcgtccgattcaccttcataaatntaacatgcacgtgggccncaggctacgaggcaagggctgcaggtgctggccagtggtctgggtcgatacgaagttntgactaatactatgactagctcgtcgtagggacggggtcctattccgattcctattacctacgtaagaacgtactaaagttacgaaacgtaaccgtacggtacttaactcgttaggaactaaaagcgaaacctacgacctagaaccncggtcggaaaccgg

SEQ ID NO: 148370 - DNA, 804 bp, Homo sapiens
  misc_feature: GYAE6OF01BC00M.40.83.H06.1.454.CMB.1.raw
  modified_base (389)..(389): a, c, t, g, unknown or other
  misc_feature (389)..(389): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccagttcggtgatcagcactgaacacagagactcaccatggtagtttgggctagagtcgttcgggttttcctcgttgtcttacgttttaaggaggttcgtcctagttcggtccgagggttcgtcgtaggtttggggtggacgttcgggtaggggggacgtcggtggtccgaggtccggtggggacgtcgaacgtgacgacttcgccgttgtcgcacgttccggtccgtacttccgtaccttacaataaatanaacatcgctacgtcgggtaccacgtagcctacgaaggccggaaaggtcgtagacgtacgggtcgtaccggcggtacccttaacggttcgttccggttagggtacggtaaacggtaagggtttaaacgttacgttaacggtaacgttaacgttaacgttaacgtacgtaccgtaaagtcctttaaccggttccggtaccggggtacgggtaacccgtttaacgtacccgttaactttacccgtactttaccggtaaacgttaaagtaacccgggtaaatttaaacccggttaaaccgggaaactaaacccggttacggtttaaccgtttataacccggtaacggtaaacgttaaaacgtaccggaaaccgttaccggtaacctaagggaaccttacggggaaccggtaaacccggg

SEQ ID NO: 148371 - DNA, 843 bp, Homo sapiens
  misc_feature: GYAE6OF01E47A2.40.83.H06.1.454.CMB.1.raw
tcagtctagcgactcacgaccggtgctcgatttagatcacgtgcgtcgcggggtcgcgggctgccctttggttttggagattggttttctcgatggggtctgggagaggagcccagcactcgaagtcggcggtgttgccattcggtgatcagcactgaacacgagagactcacagtggtagtttgggctgagtcgtttcgggttttccctcgttcgactttacgttttaaggaggttcgtccagttggtcgagggtgtacgtagggttgggtcggtagggtccgggtaggggggacggtccggttgggttcccgaacggtcccggtagggggtaaccggttcctaacggttacgggacgtacccgttccgttcccgtggtacgaccgtaccgtttaccgggttaccccgtactttaccgtaaccctttaaccaaattaaaaataacttaaaccgtatcggtaccgtaccggtcggggtacccccgaccgtaacggtcccgtaccggtaaacgggccggtaaacggtaacgcgggtacgtagggtaccgggtccgtaccggtcccgtaacggtttcggttcccggttagggtaccggttaaagttaacgggtaaacgttttaacgtcgtaacttaaacgttagttaaccggcgttaccgtaacgtacccgttcggtaccggtaggacccggggtaccttacgttacctacgtacccgttacttaccgtaacgttaacgtaacctaacttaaccggttaaacggaaaccgtaaccgtacgttacgttactaacttacggaaactaacgtaacgactacgtacgagaacccgtggtaacgaacggg

SEQ ID NO: 148372 - DNA, 718 bp, Homo sapiens
  misc_feature: GYAE6OF01B213Q.40.83.H06.1.454.CMB.1.raw
  modified_base (283)..(283): a, c, t, g, unknown or other
  misc_feature (283)..(283): n is a, c, g, or t
  modified_base (395)..(395): a, c, t, g, unknown or other
  misc_feature (395)..(395): n is a, c, g, or t
  modified_base (522)..(522): a, c, t, g, unknown or other
  misc_feature (522)..(522): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagagactacaccatggtaggtttgggctgagtcgttcgggtttttccttcgttcgtctttacttttaaggacggttgtccagttgtcgaggtgcgtaggttgggtggaggtcggtgggggnggtcggtcggtccaggccgtggggacgtcacgttgacgtaccttcctccgtggtcgcgtacgttccggtaccggtactttccgtaaccctttacaaattaaaactataaacnttcgactacggtcgggtcccgaccgacggtacctaccgtacggaaccgaacgggtaccgtgacgtacgggtggccgtacggtccctacgttggtcggttggtacggaagttaaggtaagtttacgtntactaactagttatcgggtactacgtaccttcgtacggtcgggaacgggaccttacttccgtaactaccgtaacgtttccctaagtaacgtaaacgtacttaaaccgtaaacggaaacctaacggtaaccgttactacgttacgtacgaaacgtaactacgaaccgtactaccgtacgacggtacgcgggaaacgg

SEQ ID NO: 148373 - DNA, 743 bp, Homo sapiens
  misc_feature: GYAE6OF01B7X8B.40.83.H06.1.454.CMB.1.raw
  modified_base (226)..(226): a, c, t, g, unknown or other
  misc_feature (226)..(226): n is a, c, g, or t
tcagtctagcgactcacgaccggtgctcgatttagatcacgtgcgtcgcgggggtcgcggggctgccctttggtttggagatggttttctcgatgggggtctgggagaggagcccagcactcgaagtcggcggtgttgcctattcggtgatcagcactgaacacagaggactcaccatggagttgggctgagtcttgggtttcctgttgtcttcttttaagaggtntcagtgtcgagtgcgtaggttggtggagtcgtggggggaggtcgtcgggtccaggtccgtaggggagtcacgtgacgacctctccgtgtcgctacgtccggtccggtcttcctacccttcaataaattactaacattcgaccgtaccgtcgggtcccgaccgtacggtccctaccggacgggtaccgaaacgggggtactcgggacctaggggttccggccggttacgggtacccctacggtttcggtaccggttcgggtaacggtaacggtttaggttaaaagtttacgtacggtaacctaagttaactagtacggaccttaacggtaccgtcgttacgggtacggggtacgggtaccgtaacgtttcacgttacctacgttacgtaccgttaagtaaccgtaacgtaaacgttacggaaaccgtaaccgtaaccgttacttacgtaccgaagtaactaaacggtacgaaacccgtacggaccctaagtaaccgggtggtaacccgggtaaccggg

SEQ ID NO: 148374 - DNA, 764 bp, Homo sapiens
  misc_feature: GYAE6OF01BETWU.40.83.H06.1.454.CMB.1.raw
tcagtctagcgactcacgaccggtgctcgatttagatcacgtgcgtcgcggggtcgcggggctgccctttggttttggagattggttttctcgatggggtctgggagaggagcccagcactcgaagtcggcggtgttgccattcggtgatcagcactgaacacagaggactcaccatggtagtttggctgagtcgttgggttttcctcgttgcttacgttttaagaggttcgtccagttgtcgaggtgacgtaggttgggtggtaggttcgggtggggggaggtcggttcggtccgaaggtcccgttggggacgtcgaccgttggaacgtaccttccgttaccgtggtcgaccgtacgtccggtaccggttaattccctaccctttacaaattaaacgtactaaacctagtacgacctacggtccgggtcccacgacggtcctacggaagggtaccgaacggggtctacggacgtacgggtcggcgtcggaccgtacgttcggttcgtggggtacgtaagtaacgtaaacgttgacgtacgtaactacgtatcgactaagttccgtacgttgggtacgggacggtaccttacgttacgtacttaacgtacgttaccgtacgtaacgtaacgttaaccgttaaacggtaacggaaaaccggttaacccgttaacggttaccttaacgtacgttaaacggaaacgttaaacgtacccgaaacgtccggtacgtaaacggtaccggtaaagggtaccggtaaaccgg

SEQ ID NO: 148375 - DNA, 840 bp, Homo sapiens
  misc_feature: GYAE6OF01D5K4E.40.83.H06.1.454.CMB.1.raw
  modified_base (223)..(223): a, c, t, g, unknown or other
  misc_feature (223)..(223): n is a, c, g, or t
  modified_base (797)..(797): a, c, t, g, unknown or other
  misc_feature (797)..(797): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctgagtcgttgggttttcctcgttgcttctttaagnggtgtccagtgtcaggtgcgtaggttggtggaggttcggtggggggaggcggttggtccaggtcccggtggggaggtactacgttaggaacgtaccttccgtcccgttggtcgaccgtacgttccggtaccggtactttaccctaaccctttacctaaattaaaacttaattaaacctagttcgacccgtaacggttcgggtcccgaccgacggtcccgtacccgaagggaccggaaacggggtaccgtcggaccgtacgggtcgggacccgttcggtacccgtacgtttcggttaccgggttacggggtaaccgggttaagttaaagggttaaaggtttcgtacggttaacctaagtttaaccgttacgtaccgtaaccgtaccgttaacccgtttcggtaaccgggtttcgggggtaacccggggtaccctttagttaacccgtagttacccttacgtttacccgttaacgaacgtaaacgtaacccgttaaagtttaacccggaaaagttaaccccggtacgtttaaccgtttaacgttacgagttaaacgtaaaccgtacggtaaacccncggttaaccgtaaccggtaacgtacgggtaacggaaacccggg

SEQ ID NO: 148376 - DNA, 736 bp, Homo sapiens
  misc_feature: GYAE6OF01BQS80.40.83.H06.1.454.CMB.1.raw
  modified_base (197)..(197): a, c, t, g, unknown or other
  misc_feature (197)..(197): n is a, c, g, or t
  modified_base (377)..(377): a, c, t, g, unknown or other
  misc_feature (377)..(377): n is a, c, g, or t
  modified_base (395)..(395): a, c, t, g, unknown or other
  misc_feature (395)..(395): n is a, c, g, or t
tcagtctagcgactcacgaccggtgctcgatttagatcacgtgcgtcgcggggtcgcggggctgcccttttggtttggagattggttttctcgagtggggtctggggagaggacgcccagcactcgaagtcggcggtgttgccagttcggtgatcagcactagaacacagaggactcaccagtggtagttggctagngtcgttcgggtttcctcggttgtacttacgtttaggaggttctacgaggtcgtcgaggtgacgtaggttggtaggtggtacgggtgggggacgtcggtacggaccaggtccggtgggtacgtccagtacgacgtcctctcggtgctactacgtccggtaccgtactacctaacccgttanaattaaaacgtctaacgntcgaccttacgggtcggtaccgtacggaccgtcgacggaagacggaaggccgtagcggttaaggcgtccgtaccgccgaggtttggaccggtgggtaacgtacgttaagtaacgttcgtaaccgattaacgttacgacgacgtacggaaccgttcgttacccgggtaggttacgggaccggtacttaccgtcttaccgtacgttctaaccggtaactaagtaaccgacggtaaaacgtacccgggaaaagtccggttaacgttacgttcgtaaccgtacgtaaacgtaacgtaacgtacccgtaaacgtccggtaaacaccggtccggaaccggtaaccgg

SEQ ID NO: 148377 - DNA, 854 bp, Homo sapiens
  misc_feature: GYAE6OF01DQDVA.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagtactgacacagaggacgtccaccactggtaggttggtgtctaggcgttcgggtttttcgttccgttgtcgttacttttaacgtaggtgtcgtacgtgtccgtggtagcgtaggttggtgggtacggtggttggggggacggggtcgtcggtaccgacggccgtcgggtagggtacgtacctaggtacggaccttccgtcccttcggtgtccgagttaccggttcccgggtacgtttccctacccttacccttaataaaaatttaacctaactaaacgttcgaccgtaccgttaccggggtcccggaccaccggttcccgaccgacgggacggtaacggacggttcgacgaggtcgacgttcggcccgtacgttgtcggttcggggtcggtaaggtaggttaaacttaagttcgacgttaacgttaccttaaggtcgtaccggtaactttaccggtccgtttaccggtacggggtaaccggggggtccccggtttactttacttaaacgtccctttaagttacccggtttaataaccgggtttaaaacggaacccgttaaagttaaacccggggaaaactaaacccggttaacggttaaccccggttttaacgtaccgtaccggttaaactaaaccggttaaagacgttaaacccgtacggtacctaaagggtacccggttaagggacccgggttaaacccgg

SEQ ID NO: 148378 - DNA, 780 bp, Homo sapiens
  misc_feature: GYAE6OF01ECLLB.40.83.H06.1.454.CMB.1.raw
  modified_base (247)..(247): a, c, t, g, unknown or other
  misc_feature (247)..(247): n is a, c, g, or t
tcagtctagcgactcacgaccggtgctcgatttagatcacgtgcgtcgcggggtcgcggggctgccctttggttttggagattggtttttctcgatgggggtctgggagaggagcccagcactcgaagtcggcggtgttgccatttcggtgatcagcactagaacacgagaggacctacaccgagttgggtagtttgggctggagtcgtttggggtttttcctcgtttgtctttacgttttaaaggnggttcttaccgaggttgtcgagggtgacgtaggtttgggtggacggttcgggtaggggggacggtccggttggtaccacgtccggtaggggtacggtcacgtgagtaccttctccgtggtcgtacgtacgttccggtaccggtatttaccctaaccgtttaccaagtttaaataactacgagtcgacgtacggtccgggtacccacggtacgccgtacgacgggtacgaacgggactacggcgtagggtcgggtacctacggacttacggttggtaccgggttacgggtacggtaagttaacggtaagttaacgtacgtaacgtaacttaacggttaagtcggtaccgtacgtaccgttcggttacggtagggaccggggtacttacttacgtacttatacgtaccgttaacggtaacgtaagtaacgtaaaccgttaacggaaacgtaaccggtaacggttcttaacgtacgtaacgaacgttaaactaggaacccgtatacccgtaagtaccggaacggtcggtaaacggg

SEQ ID NO: 148379 - DNA, 847 bp, Homo sapiens
  misc_feature: GYAE6OF01BK0FF.40.83.H06.1.454.CMB.1.raw
  modified_base (179)..(179): a, c, t, g, unknown or other
  misc_feature (179)..(179): n is a, c, g, or t
  modified_base (440)..(440): a, c, t, g, unknown or other
  misc_feature (440)..(440): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtggtccaggcagggctgactcagcccacctcggtntccgaaggcgttagggaccaggaccgccaacactccactgacacgtagggaacaggaccggaactaagtggttcggccgacccgaaagggaacgctaacggtcgttggccttacggacaggtaccgaacggttacccgacggggcccctaccccgtacccgaaaccttccctaccgttacccctaggttaaccggtccgtcgggaccggtaccccggtacccttacggaacgggttacctaccgtacggtaagaacggtanaacgtttacgttctacggacttacgccgttaacggttaccggaacgtaaccgtaacgaccgttacccgttacccttacgaacccgttagttaaccgaaccggtttacggtaacccttacgaaacccggtacgtacgggaacggtaacgggtaccggtacgttaaccggtaactttaacggtttaaccgttacgggttacccgacgtaccggtaacggttacggggggtaaccccgtgggttaaacctcccggttaacggtaacgggttaacggttaacggggtttccgggggttacccggtttacggggaaacccggggaacccgggtttaaaacctaaaaccgggtttcccggttaacccgggttacccggttaacgggtccctaaaaccgggggtaaccccccgg

SEQ ID NO: 148380 - DNA, 706 bp, Homo sapiens
  misc_feature: GYAE6OF01B638I.40.83.H06.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (641)..(641): a, c, t, g, unknown or other
  misc_feature (641)..(641): n is a, c, g, or t
tcagtctagcgactcacgaccggtgctcgatttagatcacgtgcgtcgcgggtcgcgggctgcctttggtttgagattggttttctcgagtgggtctgggagaggacgcccagcactcgaagtcggcggtgttcgcctagttcggtgatcacgcacgtagaacacgagacgacctcacctagtggtagttggntgagtcgttacggtttcctcgttcgtacttagttaaggngtcgtcgtagtgtacgagtcgcgtaggtggtggacggtcgggtggggacgtcggtcgtccgtacggtcggtagggagtccgtaagtcgtaacgttccgtccgttaccggtgtacggtacctacggtacccgtaccggttaaccttacccgttaaccttaaccgtaaaataaaacttaactaaaccgttagtacgacccgtacgggttaccggacccgacggtaccggtaccgtaacggaacggtaacgaacggtacgtggaacgtggtcgtacgaccgtacgtcgtcgtacggtagtacgtaagtaacgttagtacgtagtacgtataacgtgacacgtagtacctaggtcgacgggtacggtctactcgtaacgtcgtaactacgtagactaacgtaataacggtaanaaccgagttaccgtagtacgtagaactaagacagaccgtagaaccgagtaacgacggaggtaccg

SEQ ID NO: 148381 - DNA, 682 bp, Homo sapiens
  misc_feature: GYAE6OF01CQQSQ.40.83.H06.1.454.CMB.1.raw
  modified_base (148)..(148): a, c, t, g, unknown or other
  misc_feature (148)..(148): n is a, c, g, or t
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
tcagtctagcgactcacgaccggtgctcgatttagatcacgtgcgtcgcggggtcgcggggctgccctttggttttggagatggttttctcgagtgggggtctgggagaggagcccagcactcgaagtcggcggtgttgccattcggngatcagcactgaacacagaggactcaccatggtaggtttgggctgagtcgtttcgggtttcctcggttgctttacgtttaagcggtcgtccagttgtcgaggtgctaggttggtacggngtcgggtggggggacgtcgggtggtccgacggccggtggggtacggtctacgtgaagtcctctcgtggtcncgtacgtcggtacgtctacctaccttacaataaatactacgntcgctacggtcggtccacgcgtccaccgaggacgtaacggctgngtacggtgcgtcgacgtctggtccgtagggtacgaattaacggtaacgttatcgaacgttaatacgttaggccactacgttacctccgtagggacgggaccgggttctaacttcgaacttctaacctggtttaccaaacgtactaacgtaacgttaaaccgggaaagtaacccgtacggttacctaagttccccgaagtaaaccggaacgtaacgtaacccggcgttacttacgggaacgtacgggtacggaaaacgg

SEQ ID NO: 148382 - DNA, 654 bp, Homo sapiens
  misc_feature: GYAE6OF01C829J.40.83.H06.1.454.CMB.1.raw
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (468)..(468): a, c, t, g, unknown or other
  misc_feature (468)..(468): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagtcttgggttttcctcgttgcttacttttaagnggttgtccagtgtcagggtgctaggttgggtgggtaggttcggtgggggggaggtcggttgggtcccaggcccgttggggacggtcacgtgagactctccgtgtgctagtccgtcggactttcacccttacaataaatntaaacngtcgctacgttcgggtccacacggtctaccgaggaccgaagggctggactagggtcgcgtggcctacgtggttcgtgggtacgtaagttaggtaaagttntgactaatacgttatcgactaccggtaccttcggtcgacgggtacggggtccctagttctaacgttctacgttcctacgtaagtaaccgtactaaacgtttacggaaacgtaaccggtacgtacctttagtactagaactaaacgttcgaaccttacggaccgttagaccgtaggtcggtaacggg

SEQ ID NO: 148383 - DNA, 843 bp, Homo sapiens
  misc_feature: GYAE6OF01AXYNO.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatgggtagtttgggctgagtcgttcgggttttcctcgtttgtctttacgttttaaggaggttcgtacccgtaggttgtcctagggttgtaccgtaggtttggggtgggtaggttcgggtgggggggacggtcggttcggtcccgaggtccgtggggacggtcacgtagacgtaccttctccgtgtagcctacgtccggtcccggtacttaccctaccctttaccgaaattaaactaacgtaactagtacgaccgtacggttcgggtccccgaccggtacggcccttacccggaagggtaccggtaaacggggtccttacgggaccgtaacggggttcgggtaccgttcggggaccctacggtttccgggttaccggttaccggggttaccggggttaagtttaaacgggtaaacgttttagtacggtacttaacgttaacgttacgtacggtaccgttaacgggtaaccctttccgggtaccggttaacgggggacggggtaccctttagttaccggtacttacctaacgttcgttaccgtaaagtaacgtaacctaaggttaaaccggaaccgtaaccggtaccgttaccgtttaacgtccgaacgttaaaccgtaagtaccggaaaaccgtcgtaacccgtaggtaaaccggtacgtacgggaaccg

SEQ ID NO: 148384 - DNA, 859 bp, Homo sapiens
  misc_feature: GYAE6OF01CGATX.40.83.H06.1.454.CMB.1.raw
  modified_base (835)..(835): a, c, t, g, unknown or other
  misc_feature (835)..(835): n is a, c, g, or t
tcagtctagcgactcacgaccggtgctcgatttagatcacgtgcgtcggcggggtccaaaacagagcttcagcaagcatagtgggaatctgcaccatgccctgggctctgctcctctcgaccctctcactcactctgcagttgtcaggttcggtccaggcgagggctgactcgacgtccccgacccgttgggtacgtaccgaagggtacgttcgggaaccaccggacccgccaacctaccttccaaccgtggacctaaaccggtacggggaaacctagggaccgtaaacgtacgtttacggggttaccgggacccggtaacccggaaagggtaacgaccgtacggtaccggtttcggggctacggtacccagggccgtaaaccgggtacccgggaccgggtccccgtaaccccttacccgaaaaccctttcccgtacccctacccggtaacggtcccggttacggtacccgggtaccccgggaccccggttaccccgttacggaacggggttacctcccggtaacggtaaacggtacggtaacgttaccgtttacgttaccgtacctaccgttaaccgttacccggtaacgggttaaccgaacccgtaaccgtaaccgcccggttaccccgacccgttaccgaacgtacccgtacgtaaccggtaacgtaccgtaaccgtaacgtccggtaagggtaaccgggaccgtaggtacgtaccgttaacttcgttacgttacgtccgagttaccgggagtaccgggctaccgcggtcctaggagtacggtgggtagggtaccggtacgggcggaccgtaacgttccgtacggttaccgnggttaccaccgggtcgtaacccgg

SEQ ID NO: 148385 - DNA, 736 bp, Homo sapiens
  misc_feature: GYAE6OF01AOWQP.40.83.H06.1.454.CMB.1.raw
  modified_base (275)..(275): a, c, t, g, unknown or other
  misc_feature (275)..(275): n is a, c, g, or t
  modified_base (355)..(355): a, c, t, g, unknown or other
  misc_feature (355)..(355): n is a, c, g, or t
tcagtctagcgactcacgaccggtgctcgatttagatcacgtgcgtcgcggggtcgcggggctgccctttggttttggagattggtttttctcgatggggtctgggagaggagcccagcactcgaagtcggcggtgttgccattcggtgatcagcactgaacacagaggactcaccatgggtagtttgggctggagtcgtttgggttttccttcgtttgtctttacgttttaaggtaggttgtccagtggtctaggtgtcgtaggttgggtaggnggtcggtggggggtagtcggtcggtaccacggtccggtggggtacggtccgtacgtggacgtaccgtcgtaccttggtcnctaccggttccgtccggtacttaccgttaacccttacctaaattaaacttaataaacctagcgtacctaccgggtccgggtccctaccgacggtaccctacgggaacggaaccgtaagggtacctcggagtaccgggtggtcccggtcggacccgttggttccggttacgggttccggtaggttagtaaggtaacggtttcgtacgtacctaagtactagtcgacgtcgtacgtcgtacggtacggttacgggacctttagtactcctatcttactaacgtacaacggtaactaacgtaaccgaagtaccggtaacgtcgttactacgttacgaacgtaaacgcgtaacgaccgttacgaactacggtgacggtaaccggg

SEQ ID NO: 148386 - DNA, 666 bp, Homo sapiens
  misc_feature: GYAE6OF01ERO4U.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttacttttaagaggtgtccagtgtcgaggtgctagttggtggagtcgtgggggacgcgtggtccagccgtgggagtcacgtgagtacctctccgtgtgctagtccggtccggtattccaccttaccaaataaactactaactagtcgtacctacgtcgggtcccgaccgacggtcctacgagggtaccgaaggggacctggcgtacggtcgggacgtcggcctacgttcggtcgttcgggtacggtaattaggtaaagtttgacgtactaatacgtatcgtacacgtacttcgtacggtagggacgggtcctacgttcgactacgtactacgttacgtaacgacgtaaacgtaacgtaaccggaaacgtaaaccgtacggttaccttacgtcggtaacgtaaacgtaaacgtagaacccgtacgtacccgtaaggaccgtaacggtcggtaaccgg

SEQ ID NO: 148387 - DNA, 802 bp, Homo sapiens
  misc_feature: GYAE6OF01BHL8Y.40.83.H06.1.454.CMB.1.raw
  modified_base (233)..(233): a, c, t, g, unknown or other
  misc_feature (233)..(233): n is a, c, g, or t
  modified_base (787)..(787): a, c, t, g, unknown or other
  misc_feature (787)..(787): n is a, c, g, or t
tcagtctagcgactcacgaccggtgctcgatttagatcacgtgcgtcgcgggtcgcgggctgccctttggttttggagatggttttctcgagtggggtctgggagaggagcccagcactcgaagtcggcggtgttgccattcggtgatcacgcactgaaccagagacgactcaccgagtcggtagtttggctggagtcgtttgggtttccgttgttgtcgtttcgtttaaggnggtcgtcctagttcgtcgaggtgtcgtaggtggtaggtggtcggtagggggaggtcgtcggtacgaggtccggtgggtacgtccgtacgtagagtcctcgtcgtggtcgtccgtcgtccggtaccgttaccttaccgtaacccttactaaaattaaacgtactaaaccggtactcggtcccgtaacgggtccgggtaccccgaccggtacggtaccccgtaccgggaagggaaacccggtaacgggtccgtaacggaccgttggggcgggccggttacgacccggtacggttcggttaaccgggtttcgggtaacgggtaacgttaacggttaaagtttaccggtaagttaaccgttaacgtttaaacgttaacgtccggtaaccttaacgtaccgtttcgtaccgggtaggtaaccgggtccttaaccgttagtcctaacgttacccgttaactacggttaacgaacctaaccgtttaagaacccggttaacggtaaccgtacgttacgtctaaggtaacctagaaaccgtgaaaccgcgtaacgacgttacnccgggtaagaaccgg

SEQ ID NO: 148388 - DNA, 830 bp, Homo sapiens
  misc_feature: GYAE6OF01DXFJ3.40.83.H06.1.454.CMB.1.raw
tcagtctagcgactcacgaccggtgctcgatttagatcacgtgcgtcgcggggtcgcgggctgtccctttggttttggagattggttttctcgagtggggtctgggagaggagcccagcactcgaagtcggcggtgttgcctagttcggtgatcgagctactagaacacgagacggactcacctagtagggtagtttgggcttgacgttcgtttcgggttttcctcgtttgtcctttacgtttaaggcgtgtccgtagttcgtacgtaggtgtcgttaaggtttggggtcggtaagggttcgggtacgggggggtacggtccgggttcggttaccgcggtccggtggggtaacggtcgtacgtagtacgtaccgttcctcgttcgtgacgtgtccggtcgttacgtacctaccgttactaaattaaacgtaattaaacgacgtagtccgaaccggttgggaccccgtaccggaacggtccgccggtaaccgggaacggtaaggtacgttacgggctaacggtcgggtccggtacgccgttacgttaggttccggttacggtaacggtagtaacggtaagttaaggtaaccgtactaacgtagttaactagtcgtaaccgttacgttaccgtcggtacgggcgggtacgtacgttacacttacgttaccttacggttaaccgaaggtaaccttaacggttaaaccgttaaaacgaaaccggttaaaaccggtacgtttaacccgttaacgttaacgtaaccgttaaacggaaactaacccgaacggtacgtaccccggtaagtaaccggttagggtaaccccggtaacggg

SEQ ID NO: 148389 - DNA, 752 bp, Homo sapiens
  misc_feature: GYAE6OF01AQVZF.40.83.H06.1.454.CMB.1.raw
  modified_base (107)..(107): a, c, t, g, unknown or other
  misc_feature (107)..(107): n is a, c, g, or t
  modified_base (290)..(290): a, c, t, g, unknown or other
  misc_feature (290)..(290): n is a, c, g, or t
  modified_base (322)..(322): a, c, t, g, unknown or other
  misc_feature (322)..(322): n is a, c, g, or t
tcagtctagcgactcacgaccggtgctcgatttagatcacgtgcgtcgcgggtcgcgggctgccctttggtttggagattggttttctcgagtgggtctggagaggngcccagcactcgaagtcggcggtgttcgcctagttcggtgatcagcactagaacacgagacggctcacctgtcggtagtttcggacttggagtcgtttcgggtttttacctcggtttacgccgtttacgttttaaggacgttcgttccgagttcgtaccgtagggttcacgtacggtttgggnggtggttcggtgggggacgtcggtcgttccgnggtaccgtgggactcgacgtgaccgtcctcgtccgtggcgtacttacggtcccggtaaccgttcttcccaacgtttaccgaagttaaaactcgtaactagcgacctaaggttcggccgtaccgcgtacctggacgcgtacgacctgacgcggtccgtgacgttccgagttcgtaacggtcggtacgagttaacgtaggtactacgtacgtacgtcgttaacgcgtaaccgtacgttccgttacgtacggtacgggtaccggttaccgttaccgttacgtaccttaccgttaacgtttccgtaacgttaaaccggtactaacccgtaagtaaccgtaacggtaaaccgtaacgttacggtacgttaccgttaagtaccgttaacggaacgtaaccgtacggaaccgttagaaccgtacgtacggtaaccgg

SEQ ID NO: 148390 - DNA, 821 bp, Homo sapiens
  misc_feature: GYAE6OF01A3OM9.40.83.H06.1.454.CMB.1.raw
  modified_base (647)..(647): a, c, t, g, unknown or other
  misc_feature (647)..(647): n is a, c, g, or t
  modified_base (703)..(703): a, c, t, g, unknown or other
  misc_feature (703)..(703): n is a, c, g, or t
tcagtctagcgactcacgaccggtgctcgatttagatcacgtgcgtcgcgggtcgcggggctgccctttggttttggagatggttttctcgatggggtctgggagaggagcccagcactcgaagtcggcggtgttgccattcggtgatcagcactgaacacagaggactcacctagtggtagtttgggctggagtcgttgggttttccctgttgtcttagttttaaggacgggttcgtcctaggttcggttacgagggttcgcgtaggtttgggtagggtaggttccgggtaggggggggtacggtccgtttacggggtcccctaggggtccccggttagggggtaacggttccgtaacgtttacggaaccggttaacctttcccggttacctgggttacgcctaacggtttcccgggtaccggtacttttaccgtacccctttaaccgaaatttaaaacgttataaaccgtcttcggaccctacggttccgggaccccgtacgaacggtccgtaccggagggtaccggaaagggtctacggcgtacgggttcggacgtttccggacccttaggtgttccgggtagggtacccggttaaaggttaagttaaaccggtttgtacggaacttaacgtttaacgttaacncgggtaccgaagttcccttagtacggtcgggtaccgggtacctttaatcgtaaccncgtttactaccggttagtaaacgacggtaactaaccggttagaaacgttcgtaacggtttacctggttaccaagtacaaagttcccggaatccggacgtacgagtcgggacgtaaggg

SEQ ID NO: 148391 - DNA, 568 bp, Homo sapiens
  misc_feature: GYAE6OF02JV90O.40.83.H06.1.454.CMB.1.raw
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtgcagttggtggagtcgtgggggagcgtggtccaggcctgggagtcactgagctctctgtgcatcggtccgattcaccttcataaactataacntgcacgtcgggtccnccaggcctccgaggcaagggctgcagtggctggccactgtctggtcgatagaaagttngactatacgtatcgacagtacctntcgagggacgggtcctattccgattctactctacgttaagaacgtactaaagttaccgaaagtaccacggttactttaactcgtagtaaccaaagttcgaaacctggtacccttaggaaccgttacggtacccggaaacgg

SEQ ID NO: 148392 - DNA, 557 bp, Homo sapiens
  misc_feature: GYAE6OF02HMYIW.40.83.H06.1.454.CMB.1.raw
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggaggtcactgagactctcctgtgcatcgtccggattcaccttcaataaatataacatgcacgtgggtccnccaggcctccgaggcaagggactggcaggtcggctggcccagtgtctgggtacggataggtaaagttntgactatactatgcagtactctctgggacgggccgtattcatcattctactaagagtactaagttaccgaaagtaccacggtactttaacgcttacgaactaaagtacgaactacgaccctaggaacctagggtaccgaacggg

SEQ ID NO: 148393 - DNA, 537 bp, Homo sapiens
  misc_feature: GYAE6OF02J0XHQ.40.83.H06.1.454.CMB.1.raw
  modified_base (342)..(342): a, c, t, g, unknown or other
  misc_feature (342)..(342): n is a, c, g, or t
  modified_base (399)..(399): a, c, t, g, unknown or other
  misc_feature (399)..(399): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggaggtcacgtgagactctcctgtgcatcgtccgattcaccttcataaatataacatgcacgtggccncaggctccaggcaagggactgcagtggctcggccagtgtctggtcgatggaaagttngacatactatgacagtacctcgtcgtggacgggtcctattcactctactcgtacgtagacgtacaacgttacgaagaccgtcggtacttaatccgtanaactaaacgtgaacncgccttagaacgtaggtacgaacgg

SEQ ID NO: 148394 - DNA, 508 bp, Homo sapiens
  misc_feature: GYAE6OF02GP7BV.40.83.H06.1.454.CMB.1.raw
  modified_base (453)..(453): a, c, t, g, unknown or other
  misc_feature (453)..(453): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtcccaaggacttgggacagaccgccacactcacctgcactgggaacagcgacaatgttggcgcccaaggagcagcttggctgcagcagtaccagggccgccctcccaaacctcctctccccatacggtctggcgacccggccctcagggatctcagagagatattctgcatccaggttcgacgaacacacgcctccctgaccatccactggacctcaacgcctagacggacgaggctgactattactgttcagtcagtcgggacgcagcctanagtgagtgggtgttcggcggacggactaacgtggtcccgtcgtaggtcagacccg

SEQ ID NO: 148395 - DNA, 537 bp, Homo sapiens
  misc_feature: GYAE6OF02GNJQS.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactccctctcccataggtctcggcgaccggccctcagggactctcagagagatagttctgcatcctaggttcgcgaacacacgccctccctcgaccatcactggacctcaacgcctcgaggacgaggctgactattactgttcagcagtgggacgcgacgcctcagtagaagttggggtacggttcgggcggtacgggaacccgtaacggttcggttacccggtaccgtacggttaccgacgtaccccgg

SEQ ID NO: 148396 - DNA, 605 bp, Homo sapiens
  misc_feature: GYAE6OF02G63WI.40.83.H06.1.454.CMB.1.raw
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtgcagttggtggagtcgtgggggagcgtggtccagccgtggggaggtcactgagactctcctgtgcagtcgtccggattccaccttcaataaatataacatgcacgtcgggtccnccaggcctccgaggcaagggctgcaggtggctggccctagtgtcgtgggtcgataggtaaagttntgactattaactatcggacacgtaccttcgtacgtaggggacggggtccctagttccattcacttcctacgtaagacgtaaccttaaagttaccgaaacgtaccgtaccggttactttaacgtaccttaggaacctaaaacgtggaaaaccgtcggtacccgttaaggaacctacggtacggaaccggg

SEQ ID NO: 148397 - DNA, 499 bp, Homo sapiens
  misc_feature: GYAE6OF02HX8JO.40.83.H06.1.454.CMB.1.raw
  modified_base (441)..(441): a, c, t, g, unknown or other
  misc_feature (441)..(441): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactggaacagcgacaatgttggcgcccaaggagcagcttggctgcagcagtaccagggccgccctcccaaactccctctcccacaggtctggcgaccggccctcgagggatctcagagagatattctgcatccaggttcgcgaacacagccctcctgaccatcactggactcaagcctagacgacgagctgactattactgttcagcagtgggacggcacgcctnagtgagtgggtgttcgggcggtaaggaccaacgtcgtccgtacgtaggtccagacccg

SEQ ID NO: 148398 - DNA, 529 bp, Homo sapiens
  misc_feature: GYAE6OF02FP43T.40.83.H06.1.454.CMB.1.raw
  modified_base (352)..(352): a, c, t, g, unknown or other
  misc_feature (352)..(352): n is a, c, g, or t
  modified_base (414)..(414): a, c, t, g, unknown or other
  misc_feature (414)..(414): n is a, c, g, or t
  modified_base (466)..(466): a, c, t, g, unknown or other
  misc_feature (466)..(466): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcaggtgcagttggtggagtcgtggggggaggcgtggtccagcctggggagtcactgagactctcctgtgcatccgtccggatttcaccttcaataaatataacatgcacgtgggtcccnccaggctccgaggcaagggctggcaggtgctggcccacttgcgtgggtcggatagaaagttntgactatactatgacagactctctggacggggcctattcatcatctctaganactaatacgaagacacggtactttatctagactaatagaactacgacctagacagtagaacgg

SEQ ID NO: 148399 - DNA, 586 bp, Homo sapiens
  misc_feature: GYAE6OF02IZ568.40.83.H06.1.454.CMB.1.raw
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
tcagtctagcgactcacgaccggtgctcgatttagatcacgtgcgtcgcggggtcgcggggctgccctttggtttggagatggttttctcgatgggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcaggttggtggagtcgtgggggagcgtggtccagcctggggagtcacgtgagactctcctgtgcagtccgtccggattccaccttccaataaactataaacatgacacgtcgggtcccnccaggcctcagggccaaagggctggcaggtcggctacggcctacgtgtcgtgggtcggataggtaaagttntgtacattactagtgactagtactcgtcgtagggacgggcctagttccattcattcgtactagacgtaacaacgttacgaaacgtacgtacggtacgtttaactctacggtaactaacgtacgaacgtcgtacccgtagacggtacggtacgtaaccgg

SEQ ID NO: 148400 - DNA, 523 bp, Homo sapiens
  misc_feature: GYAE6OF02F0WDQ.40.83.H06.1.454.CMB.1.raw
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagnggtgtccagtgtcaggtgcagttggtggagtcgtggggggagcgtggtccagcctgggaggtcactgagactctcctgtgcatcgtccggattccaccttccataaatataacatgcacgtgggtccnccaggctccaggcaagggctggcaggtggctggccacgtgtctggtcgatgaaagttngacatactatgacagactctcgtggacgggcctattcgatcatctactaganactaattaccgaagacacggtactttaancctagaactaatgaacncgcctagactacgtgaacgg

SEQ ID NO: 148401 - DNA, 638 bp, Homo sapiens
  misc_feature: GYAE6OF02G7JKR.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccacccgtcggtgtccaaggacttgggacagaccgccacactcacctgcactgggaacagcgacaatgtggcgaccaaggagcagcttggctgcagcagtaccgacgggcccgaccctacccgaaacctccctcctaccccacgtacggtcctacgggccgaccccgggtccctacgacgggacttccgtacgaaggagacgtattacttcgtacgactacgttccgtaacgggttccgaccgaaaccacgaccgtacccctacccgtacgaaccctactaccgaccgtacggtaacctacgaacgtccgtacggaacggaccgacggtcgttacgtaacttacgttacttacgttacgacgacgtacggtacgggtaccggctacgtccgtacgtagtagtaacggtgggtacgtcgggacggacggaaccgtacggtcggtaccgtacgtacggtccgacgtacccgg

SEQ ID NO: 148402 - DNA, 661 bp, Homo sapiens
  misc_feature: GYAE6OF02HT65D.40.83.H06.1.454.CMB.1.raw
  modified_base (249)..(249): a, c, t, g, unknown or other
  misc_feature (249)..(249): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtggtccaggcagggctgactcagccaccctcggtgtccaaggacttgggacagaccgccacactcacctgcactgggaacagcgacatgttggcgcccaaggacncagcttggctgcagcaggtaccagggcccgcccctacccgtaaacctccctacctccccacgacggtccgtcggccgacccggcccctagacgggtactcctcgaagagagattagttctgactatccgaaggttccgacgaacacgacgccctccctacggaaccactaccaacgtcggaacctacgaactcccgtaggaacgggacggacgtacgtacgtaaccttaagttaccgttacgtttacgaacgtccgtaacggttcggggaacccggtacaacccggtacccgtaccgtaggttacggtaagggtcggggtttacggtaccgggacgggggtaacggaaccccgtaaacggttcccggttacccggtaacccggttacgggtaccctaccgggtaaccccggg

SEQ ID NO: 148403 - DNA, 598 bp, Homo sapiens
  misc_feature: GYAE6OF02JCYN8.40.83.H06.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagctgggttttccncgttgctctttaagnggtgtccagtgtcaggtgcaggttggnggagtcgtggggggagcgtggtccaggccgtggggagtcacgtgagactctcctgtcgcagtcgtccggattccaccttcaataaactataacntgcacgtgggtccncaggctaccgaggcaaagggctggactaggtggctcgggccctagttgtccgtgggtacgaataggtaaaagttngactatactatgacagtactcgtcgaggacgggtcctaattccattcctagttcctacgtaagtacgaactaaacgttccggaaagtacgtaccggtactttaactacggtagtaaccgtaaaagttcgaaaccgacggtaccgttaggaacgttacggtaccgaaacggg

SEQ ID NO: 148404 - DNA, 604 bp, Homo sapiens
  misc_feature: GYAE6OF02H89HC.40.83.H06.1.454.CMB.1.raw
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactccaccatggagtttgggctgagcttgggttttcctgttgcttcttttaagaggtgtccagtgtcaggtgcgtagttggtggagtcgtgggggagcgtggtccagccgtgggaggtcacgtgacgactctcctgtgcagtccgtccggattccaccttcataaactntaacatgcacgtggtccncaggcctcgaggcgaaggactgcaggtcgctcggcctagtcgtcgtggtacggtagtagtaaagttagtacggactagttaacttacgtacggtacgtacgttacctcgttacgttacggggaacgggtacccgtagttactacgttctaacttccttacgtaagaacgtactaaacgttacgaactacgacggttactactgtacgaactaacgacgtaacgacgtacgtacgaactcggtacgaacgg

SEQ ID NO: 148405 - DNA, 624 bp, Homo sapiens
  misc_feature: GYAE6OF02HLQNN.40.83.H06.1.454.CMB.1.raw
  modified_base (355)..(355): a, c, t, g, unknown or other
  misc_feature (355)..(355): n is a, c, g, or t
  modified_base (442)..(442): a, c, t, g, unknown or other
  misc_feature (442)..(442): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgctagttggtggagtcgtgggggagcgtggtccaggcctgggagtcagtgagactctcctgtgcatccgtccggtattccaccctttcaattaaatataaacatcgcacgttcgggtccnccgaggcctccgaaggccgaaagggactgcgtagtggctaggcccagtcgtctggggtcgagttagaaagttatgactataccgtancggacagtaccttcgtacgtgggtacgggccctaattccgtatccgtattccgtaacgtaacgactaacgtaaacttacggaaatacccgtacggttaccttaatcggtaactaaccgtaaaacgttaccggtaaaacgtacccggtacccttacgggaacctacgggtaccggaaaccggg

SEQ ID NO: 148406 - DNA, 685 bp, Homo sapiens
  misc_feature: GYAE6OF02G00V4.40.83.H06.1.454.CMB.1.raw
  modified_base (221)..(221): a, c, t, g, unknown or other
  misc_feature (221)..(221): n is a, c, g, or t
  modified_base (455)..(455): a, c, t, g, unknown or other
  misc_feature (455)..(455): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagnggtgtccagtgtcaggtgctaggttggtggagtcgtggggggagtcggtggtccaggccgtggggagtcacgtgagtactctcctgtcgcagtccggtccggattccaccctttccaattaaactataacatcgcacgttcgggtccgccaggcctcccgagggccgaaggggactggacctaggtggcctgggcccacgttcgtcgtgggtacggtagtaggtaaagtttagngactaagttacttagtcgacaagtaccttcgtcgtaggggaccggggtcctaatttccagttacctacgtttccgttacgttaaacggaacgtaaaccttaaacgtttacccggaaaaggtaacccgtaaccggttaccgttttaagtaccgttacggaaaccttaaaacgttaccgaaaccgtaccggttaccccgtaaggtaacccgtacgggtacggtaaacccggg

SEQ ID NO: 148407 - DNA, 706 bp, Homo sapiens
  misc_feature: GYAE6OF02J2QFZ.40.83.H06.1.454.CMB.1.raw
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (660)..(660): a, c, t, g, unknown or other
  misc_feature (660)..(660): n is a, c, g, or t
  modified_base (673)..(673): a, c, t, g, unknown or other
  misc_feature (673)..(673): n is a, c, g, or t
tcagtctagcgactcacgaccggtgctcgatttagatcacgtgcgtcgcggggtcgcggggctgccctttggttttggagattggttttctcgagtggggtctgggagaggacgcccagcactcgaagtcggcggtgttgccattcggtgatcagcactgaacacaggacgactcacagtgggttaggttggctgacgtcggtttcgggtttcctcgttacgtctttagttaaggtcggttctccgtagttcgtacgtagggtcgtacgtgggttgggtcgggtacggttcggggtaggggggcggtcggttcggtaccgacggtccggtaggggacggtcacgtaggacgtcccttcgttccgtgcgctacggtccggtaccgtactcctaccttcaaacttaaatactaactgtcgtaccgtacggttcgggtcccgaccgacggtccctacggacgggtaacggtaacgggcttacgggacgtacggggtcggtaccgtcggtaccctaacggtttcggtcggttacgggtacggtagttaacggttaagtacgcgtacttagtactagacgtactgttaacctcggttacgtacggggtaccgggtccttacgnttacncgtactcgaagtacgagtaactacgtaacacggtacncgttacgtcaganaataacacgactacgcacgcgacgtggtaaccg

SEQ ID NO: 148408 - DNA, 577 bp, Homo sapiens
  misc_feature: GYAE6OF02G5JVQ.40.83.H06.1.454.CMB.1.raw
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (414)..(414): a, c, t, g, unknown or other
  misc_feature (414)..(414): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtgcaggttggtggagtcgtgggggagcgtggtccagccgtgggagtcactgagactctctgncatcgtccgtatccaccttacaataaatataacatgctacgtcggtccgcgacggctaccgaggcgaaggcngctagtcggctggcctagtcgtcgtggtcgtatagtaaagttncgactattaactagtgactacgtaccttcgtaccgtaggggaccgggtcctaacgttcacgtctactctacgtagacgtaactaagttacgaaacgaccgtacggtacttaagcgtacgaactaaagtacaacgtcgtacctacggaacgtaggacgaacggg

SEQ ID NO: 148409 - DNA, 598 bp, Homo sapiens
  misc_feature: GYAE6OF02JNRHF.40.83.H06.1.454.CMB.1.raw
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (553)..(553): a, c, t, g, unknown or other
  misc_feature (553)..(553): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtggggggaggcgtggtccaggcccgtgggaggtcactggagactctccgtgtgcatcgtccggtattccaccttccaattaaactataaacatgcactcggggtccnccaggtcctacccgagggaccgaagggactggcagggtggctcgggacctacgtgtcgtgggcggtagtacgaaagtttangacctagtactatacgcacgtacttctacgtcggacgggtccgtattcgactcgtatccttacgttagaacgactaacgttcgaaacgtacgtaccggtaccttaagttaccnggtaacaacgttcgaactcgacgttacgacgtaccgtagaacggg

SEQ ID NO: 148410 - DNA, 553 bp, Homo sapiens
  misc_feature: GYAE6OF02IOB8U.40.83.H06.1.454.CMB.1.raw
  modified_base (343)..(343): a, c, t, g, unknown or other
  misc_feature (343)..(343): n is a, c, g, or t
  modified_base (403)..(403): a, c, t, g, unknown or other
  misc_feature (403)..(403): n is a, c, g, or t
tcagtctagcgactcacgaccggtgctcgatttagatcacgtgcgtcgcggggtcgcggggctgccctttggtttggagatggttttctcgatgggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggagtcactgagactctcctgtgcatcgtccggattccaccttcataaatataacatgcactgggtccnccaggcctccgaggccaagggctgcagtggctggccatggtctggtcggatagaaagttntgacatactatgacagtactctcgtggacggggccgtattcgatctattaccgtcttaagaacgaactaagttacgaaacgtaacacggttaccttaatactacgaactaaagtagaactacgaccgtaggacctaggtaccggaacggg

SEQ ID NO: 148411 - DNA, 639 bp, Homo sapiens
  misc_feature: GYAE6OF02G09I8.40.83.H06.1.454.CMB.1.raw
  modified_base (347)..(347): a, c, t, g, unknown or other
  misc_feature (347)..(347): n is a, c, g, or t
  modified_base (440)..(440): a, c, t, g, unknown or other
  misc_feature (440)..(440): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggaggcgtggtccagcctgggagtcactgagactctcctgtgcatcgtccggattccaccttccaataaatataacatgcacttgggtccnccaggcctaccgagggcaacggggtactggcctaggtcggctgggaccctacgttcggttcgtgggtaccggtaagttacggtaaaagtttancggtactaattaccgtaagtcggactaacggtccttcgtcgtacgggacgggggtccctattccgtaacttctaacttccttacgtaagacggtaaacctaaagttaccgaaagtacccgtacggtactttaacgtccgttaaggaacctaaaagttcgaaaccgtacgtacccgtaggaacgtacggtaccgaacggg

SEQ ID NO: 148412 - DNA, 614 bp, Homo sapiens
  misc_feature: GYAE6OF02GLLJ8.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggcccgccctcccaaacctccctctcccatacggtcctcggaccgaccggcccctcagggactcgtcagagagatattctgcatcctaggttcgacgaaccacacgcccttccctacgaccactccaaccgtcggaccttaccaacgtccctaggaacggtaccgacggactagtaaccgttaactttaaccgtgtttaccgaggtctaacggttcggggaaccgggctaacggacctacgtacggtgtaaacggttcggggttacgttccgggggaccggtaacggggaacccgtaaacggtcggttaccccgttcgtacggtaccgacggtaaccccgg

SEQ ID NO: 148413 - DNA, 544 bp, Homo sapiens
  misc_feature: GYAE6OF02F7OFG.40.83.H06.1.454.CMB.1.raw
  modified_base (343)..(343): a, c, t, g, unknown or other
  misc_feature (343)..(343): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagtgtcaggtgcagttggtggagtcgtgggggagcgtggtccagccgtgggaggtcactgagactctctgtgcatcgtccggattcaccttcataatataacatgcacgtgggtccnccaggctccaggcaagggctgcagtgctggccactgtcgtggtcggatgaaagttgtgctatactatgcagactctcgtgacggggccgtattcactctattctcgttaagacgtaactaacttacgaagtaccgtaacggtacttaagtcctacgaactaaacgtagaactacgaccgtacgacgtacggtacggaacgg

SEQ ID NO: 148414 - DNA, 590 bp, Homo sapiens
  misc_feature: GYAE6OF02HQORM.40.83.H06.1.454.CMB.1.raw
  modified_base (355)..(355): a, c, t, g, unknown or other
  misc_feature (355)..(355): n is a, c, g, or t
  modified_base (417)..(417): a, c, t, g, unknown or other
  misc_feature (417)..(417): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtgcagttggtggagtcgtgggggaggcgtggtccagcctggggagtcactgagactctcctgtgcatcgtccggattccaccttccaattaaatataaaccattgctacgtgggtcccnccaggcctccgagggcaagggctgcaggtgctggccagtgtcgtggtcggataggaaagttntgactataactagtcgactacgtacctcgtcgtgggacgggtcctattccattccatcctataagaactactaaacgttaccgaaacgtaacctaccggtactttaacgtaccttagaacctaaaatcggaaacctacggtacccgttaagaaccgtaggtacccggaacggg

SEQ ID NO: 148415 - DNA, 697 bp, Homo sapiens
  misc_feature: GYAE6OF02JSHFI.40.83.H06.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
tcagtctagcgactcacgaccggtgctcgatttagatcacgtgcgtcgcggggtcgcggggctgccctttggttttggtagatggttttctcgatggggtctgggagaggagcccagcactcgaagtcggcggtgttgccattcggtgatcagcactgaacacagaggactcaccatggagtttgggctgagctgggttttccngttgctcttttaagaggtntccagtgtcaggtncaggttggtggagtcgtggggggagcgtggtccaggccgtgggaggtcacgtgagactctcctgtagcagtcgtccggattcaccgttccataaatactaacatggacacgtcgggtccgccgaaggcctcccgaagggccgaaacggggtactacggccgtaaggtcgggccgtacgggcccgaacgtttcggttacccggttggggtacccgggtaagtttacgggtaaaaacgttttgtacgggtacctaagtttaaacccgtaagtgggttaccaaacggttaacccttcttacccggtaggggtaccggggtacccgttactttacgtaacgttccgtaattccgtaccgttaagaacgtactaacgttacgaacgtaaccacggttacttaacttacgtacggactaaaagttcgaacgtacgtacccgttagaaccggtagtacgggaaccgg

SEQ ID NO: 148416 - DNA, 530 bp, Homo sapiens
  misc_feature: GYAE6OF02HJI0R.40.83.H06.1.454.CMB.1.raw
  modified_base (205)..(205): a, c, t, g, unknown or other
  misc_feature (205)..(205): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (344)..(344): a, c, t, g, unknown or other
  misc_feature (344)..(344): n is a, c, g, or t
  modified_base (398)..(398): a, c, t, g, unknown or other
  misc_feature (398)..(398): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatgggagtttgggctgagctgggttttccncgttgcttctttaagnggtntccagtgtcaggtncagttggnggagtcgtgggggagcgtggtccagcctgggagtcactgagctctctgtgcatcgtccgattccaccttcataaatataacatgacacgtgggtccncgaggcctccgaggcaagggctgcagtgctggccatgctggcgatagaaagttngctatactagcgcacgcttacgtcgtggacgggcctattccatcatctagtagagaactaagtcgaagaactcggactttacgtacgtacgaacgtaatacgaacgacggtctacggacacggtacgaacgg

SEQ ID NO: 148417 - DNA, 646 bp, Homo sapiens
  misc_feature: GYAE6OF02FMI4K.40.83.H06.1.454.CMB.1.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggngcagcttggctgcagcagtaccagggccncccctcccaaactcctcctcccatacggtcctggccgacccggccctcgagggactctcaggagagatattctgcatccaggttcgcgaacacacgtccctccctgacccatccactcggacctccaacgcctaggacggacgacgggtcctaggtaaccttaagtttaccgttgtttaccgaaggtacctaaggttacggggaaccgggtcgaacggtcccctacgtacggttacggtaaagggttcgggggttacggtttaccgggggaccgggggttaacggggtaaaccccgtaaaccggttaccgggtttaccccgggttaccccggtttaacggggttacccgtaacgggtaaccccccggg

SEQ ID NO: 148418 - DNA, 805 bp, Homo sapiens
  misc_feature: GYAE6OF02G08BA.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtggtcgaggcgagggctgactcgagcccacccgtcggtcgtaccgaaagggtcgttgggacacggacccgccaccaccgtccacctgaccacgtagggaaccacggccgaacaagttcggttacggcccgaccccgaaagggacgccgaaggtccgtttcgggcgtcgacgtacgacgtaaccggttaacccggaccgggggcccccgtacccccgtaccccctaaaacccgttcccccgttaccctacccccgaaccggtacggttccggtaccgggaccccggtacccccgggtaccccctacggacgggaccgttacccgtacggtaaacggtacggaacgttaatttacgttaccgtacgtacctaccgttacccgtacgggtttaccgacccggtaaaccaccgtaccggccccttccccgtaacgaaccccttcgtacccgtaccgtcgggtaaaccctccggtaaaccgaccggttaggaccgggtacggtaacggtcctacggtaactttacgtttaccgttcggttacgacggtacgtagggtccgggtaacggacctacgccgtagtacggttacgtagggttcgggtacggttcgggacggtaaccggtaacgtacgtcgtacccggtcggtacgccgtaccggtaccgg

SEQ ID NO: 148419 - DNA, 593 bp, Homo sapiens
  misc_feature: GYAE6OF02GJ19P.40.83.H06.1.454.CMB.1.raw
  modified_base (340)..(340): a, c, t, g, unknown or other
  misc_feature (340)..(340): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (569)..(569): a, c, t, g, unknown or other
  misc_feature (569)..(569): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttctttaagaggtgtccagtgtcaggtgcagttgggtggagtcgtgggggaggcggtggtccagccgtggggagtcactgagactctcctgtgcatccggtcggtattccaccttccaataaatataacntcgctacgtgggtcccnccgaggtcctccgagggcaaagggctgcgtaggtggcgtcgggccctacgtcgtcgtcggtacggtataaggtaaacgtttnacggtctaacgttactacgtgacctataccgtcgttcgtgggacgggcctattcattctactctacgtaagacgactaattaccgaaagtaccgtacgtattaacgtcgtacgaaacttaagtacgaacncgtaccagacgtacggcgaacggg

SEQ ID NO: 148420 - DNA, 592 bp, Homo sapiens
  misc_feature: GYAE6OF02I2TD4.40.83.H06.1.454.CMB.1.raw
  modified_base (222)..(222): a, c, t, g, unknown or other
  misc_feature (222)..(222): n is a, c, g, or t
  modified_base (442)..(442): a, c, t, g, unknown or other
  misc_feature (442)..(442): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcgttgggttttcctcgttgcttctttaagnggtgtccagtgtcgaggtgcaggttgggtggagtcggtggggggaggcggtggtccaggccgtggggaggtcacgtggacgtacctctccgtgtgcagtccgtccggtattccacccttcaataaatataacatgctacgtgggtccgcacggcctaccgaggcgaagggctgcgaggtcggtcgtcggacctatcggtcgtggtcggataggaagttanagtctaatactatgactacgtacttcgtcggtgggacgggtctacttctatccactctagtaagacgaactaacgtaacgaagacgtcggtacttactctacgaactaacgtacaacgtacgtaccgtacgaacgtcggtaacggaacgg

SEQ ID NO: 148421 - DNA, 618 bp, Homo sapiens
  misc_feature: GYAE6OF02JYVUQ.40.83.H06.1.454.CMB.1.raw
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacacgaccgccacactcacctgcactgggaacagcgacatgttcggcgccaaggagcagcttggctgaacngcagtaccgagggccnccctcccaaactcccncctcccatacgtcctggccgaccggccctcgagggactctcgagtacgagattacttcgtgcagtacccgaggttccgaccgtaacaccacggcccctcccgtacgaaccccatccacgtcggaactccaaacgccgttaggacggacgacgggtctacggaaccttacttacgttacgttacgacgacgtacggtgggaaccggccgtacgcccttacgagtacggtaaggtcggggttacgttacggggacgggtaaccgggtaaccgtaaaccggttcggtaccccggttacggtacgggtccgaaccggtaacccgg

SEQ ID NO: 148422 - DNA, 734 bp, Homo sapiens
  misc_feature: GYAE6OF02H9OIW.40.83.H06.1.454.CMB.1.raw
  modified_base (204)..(204): a, c, t, g, unknown or other
  misc_feature (204)..(204): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagtcttgggttttccncggttgcttacttttaaggnggttcgtccaggtcgtcagggtgctaggttggnggagtcgtggggggacgtcgttggtccaggtccgtggggacgtcacgtggaacgtccttcgtccgtggtcgctacgttccgtaccggtattcccgtacctttaccaagttaaactactaactgtcgcctaacggtccgggtaccncgtacggcctacggagcgtaagggctcggacgtggtcgtcgtcggacctacgttcggttcgtacgggtacgtagtaacggtaaacgtttcacggtactacgttacgtacgtacggtaccgtaacggttaccgttacgtacggttcgggaccggggttacctaacgtttccggtaagttcccgttaacgttccgttaccgtaaacgggttacctaaaccgttaaggttaaccgaacggtaaacccgttcggtacgtttaacgtaccgtcgtaaacgttaaacgtacggaaccgttcggtacccgtaaggtaaccggtacggttacggaaccgg

SEQ ID NO: 148423 - DNA, 701 bp, Homo sapiens
  misc_feature: GYAE6OF02JYX5I.40.83.H06.1.454.CMB.1.raw
  modified_base (366)..(366): a, c, t, g, unknown or other
  misc_feature (366)..(366): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgcctattcggtgatcagcactgaacacgagaggactcaccagtggtaggttggctgtacgtcgtttggtttcctcgttgtcttactttaggagtcgtccgtaggttgtcgtacgggtgtagtaggttacgggtggaggtcgggtgggggagtcggttcgtcctaggtccggtagggacgtcgtagtgacgtactcgtcgtgtacgcgtcgtccgtacgtctacctacctntaaactaacgtataacgtgtcgacgtcgtcggtccaccgtcgactccgaggtcgaacggtctgacgtggcggtctccggtactacgttagtcggtacgtagtaagtagtaagtacgtagtactaacgttacgacgtaacgtgtaacgttacccgtaggttacggtccgggtaacgtccgttaattaccgttacttaacgttaccgtgtaaccgtaaacgtacgtaaacgttaacgaacggtaaccgttaccgtggtttaacctggtaacctaacgtaacgtaaccgtaacgacccggtacgtaacggtcggtaaacggcgggtttaaccgaacgg

SEQ ID NO: 148424 - DNA, 673 bp, Homo sapiens
  misc_feature: GYAE6OF02JWAHV.40.83.H06.1.454.CMB.1.raw
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttggctgagctgggttttcctcgttgcttacttttaagaggtgtccagtgtcaggtgcaggttggtggaggtcgtgggggggaggcggtggtccgaggccgttggggacggttcactggacgactctccgtggtcgctagtccggttccggtacttccacctttaccaacttaaaattactaaacagtcgacgtacgttcgggtcccgtaccgaggcccttccgaaggtccgaaaggggtacttcggacgtagggtcggtccgtacgggacccctagttcggtcgttacggggtacggaacgttaggtaaaacgtttagtcgactattaccgttanagtcgacgtacncgtcgtagggtacgggcttactcgtactctactccgtacgtacgtaacgacttaacgttaacgaacgtaccgtcgtaactttcgtaccgtacgtaacctaagttaacgaactaccggtcgtacgaacggtacgacggtaaccgg

SEQ ID NO: 148425 - DNA, 723 bp, Homo sapiens
  misc_feature: GYAE6OF02IIGWT.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctagggttttcctcgttgcttacttttaaggaggtgtaccagtgtcaggtgcagttggtggagtcgtgggggagtcgtggttccagccgtggggacggttcacgtggacgaccttcttccgtgtcgactacgttccggttacccgggtatttacccgaaccccgtttccaaagtttaaaactaactaaaaccgtagtcgtacctaacggttcggggtccccaccgacggtcccttaccgaagggtaccgtaaacggggtacttcggaccgtagggtcggtcgttcgggtaccctacgtttcgggtccgtaggggttacggtaagttaacggtaaaagttagtcggtaactaattacttagtcgaccgtaagtcctaccgttagtcgggtacgggtaccgtacgttacgtaacgtctacgttccgtacgtaagtacgaacgttaaacgtacgaaacgtaccgtacggtacttagtctaacggtaactaacgtacgaacgtacgacccgttacgacgtacggtacgtaaccggg

SEQ ID NO: 148426 - DNA, 657 bp, Homo sapiens
  misc_feature: GYAE6OF02I14RH.40.83.H06.1.454.CMB.1.raw
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (614)..(614): a, c, t, g, unknown or other
  misc_feature (614)..(614): n is a, c, g, or t
tcagtctagcgactcacgaccggtgctcgatttagatcacgtgcgtcgcggggtcgcggggctgcccttttggtttggagatggttttctcgatggggtctgggagaggagcccagcactcgaagtcggcggtgttgcctattcggtgatcagcactgaacacaggaggactccaccagtggtagtttgggctgagtcgttgggttttcctcgttgcttcttttaaggaggttgtcctagtgtcgtaggtgtcgtaggttgggtgggtagtcggtgggggagcggttcggtccgagccgtggggacggtcacgtgacgtaccgtctccgtgtgtctagtccggtccggtattccgaccttacaattaaatataaacntgcacgtcgggtccnccgtaggcctaccgaggcgaacgggatcgcgtaggtcggaccgtcgggaccctcgttacggttccgtaggggttaccgggaattaacgggaaaaggtttcgtacgactaagttaacctaacgtcgaacgtactaacgttcgtacggtagggcgggtaccgttataccgtatcctatcgtacgtacgactaaactagtaacgtaagacgtacgtactaacgtntacgaataactaggaacgtactacgtgaacgtaggacgtacgg

SEQ ID NO: 148427 - DNA, 716 bp, Homo sapiens
  misc_feature: GYAE6OF02JUDBG.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagcccaccctcggtgtcccaaggacttcgggacacggaccgccacgactcacctgcacgtgggaacagcgaacaatcgttggccgaccgaaggcgcgagtcgttggctgcagcagtaccgacgggcccgccctacccaaacgtccctacctaccccgaccgtacggtccgtacggacccgacccgggcccctacggacgggtacctccgtacgaacggtacgtaacgtaacgtacttccgtacgaacgtacctacccgttacgggttaccgacgggtaaaccctacgtaccggtacccctacccgtacgaacccgtacttccgaaccgtcggacctaccgacgtccgaggtaacggacggtcggtactacggtaaccgttacgttaccgttacggtaccgtacgttacgagggtacggtacgtaccgtaccgacgttcccggagtccgggtaacggttgggttacgggtacgggttaccgggaaccggttaaccggttaaccggtaccgggttaccgtaccggtttaaccggcgttaacccgaacccggg

SEQ ID NO: 148428 - DNA, 673 bp, Homo sapiens
  misc_feature: GYAE6OF02F9U6T.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtcgtccaagggacttgggacacgaccgccaccactcacctgcacgtgggaacagcgacaatgtcggcgccgaaggcgcagcttggctgcacgcgagtaccgacgggcccgccctaccaacctccctctccctacgcggtcctcggccgacccggccctacgacggtactcgtacgaagaagacgtattacttcgtgactacgtccgagggttccgaccgtaacacgaccgtaccctacccgtacgaaccctacgtcctacgtacggacctaccgaacgtccgtacgggtacggacggacggtacgtacgtacttaacgttacgtacgttccgacgtcgtaacgtcggggaccgtacggtaaccgtcccgtacgtacggttaacggacgggtttcgggttaccggttaccggggaaccgggtaaccgggtaacccgttaaacgggttccggttaccccggttacgggtaccggttaccggtaccggtaaccccggg

SEQ ID NO: 148429 - DNA, 605 bp, Homo sapiens
  misc_feature: GYAE6OF02FJ66C.40.83.H06.1.454.CMB.1.raw
  modified_base (224)..(224): a, c, t, g, unknown or other
  misc_feature (224)..(224): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgttgcttcttttaaaggnggtcgtccagttgtcaggtgctaggtttgggtggagttcggtggggggaggtcgtggtccaggccgtggggagtcactgacgactctctgtncatcgtcgattcaccttcaataaatntaantgcacgtgggccncaggctccgaggcaagggactgcaggtgctcggccacgtgtcgtggtcgatagaaagtttncgtacaatacgtatgacagtacttcgtacgtcgggacgggtcctattaccgattcctagttactacgtaacgaactaacctaaacgttacggaaacgtaccgtacggttaccttaagtacccgtaagtaactaaacggttacgaaccgtaacgacccgtaagaaccggtaggtacccggaacggg

SEQ ID NO: 148430 - DNA, 566 bp, Homo sapiens
  misc_feature: GYAE6OF02FGB6L.40.83.H06.1.454.CMB.1.raw
  modified_base (349)..(349): a, c, t, g, unknown or other
  misc_feature (349)..(349): n is a, c, g, or t
  modified_base (429)..(429): a, c, t, g, unknown or other
  misc_feature (429)..(429): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagttgtcaggtgcagttggtggagtcgtggggggaggcgtggtccagccgtgggaggtcacttgagactctcctgtgcatcgtccggattcaccttccataaatataacatgctactgggccncgaggctccgaggcgaagggctggcagtcggctgggcctacgtgtcgtcggtcggatggtaaagttatgactatactagngacagtacctctcgtagacgggcgtattacgatcctactctacgtacgagtaacgtagttacgaagacctaggtccttaagtcctacggaactaacgtagaacctacggtacctaggaccgtaggtacgtaaccggg

SEQ ID NO: 148431 - DNA, 562 bp, Homo sapiens
  misc_feature: GYAE6OF02GP36X.40.83.H06.1.454.CMB.1.raw
  modified_base (351)..(351): a, c, t, g, unknown or other
  misc_feature (351)..(351): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (531)..(531): a, c, t, g, unknown or other
  misc_feature (531)..(531): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcaggtgctagttggtggagtcgtggggggagcggtggtccaggccgtggggagtcactgagctctctgtgcatcggtcgattcaccttcaataaatataacatcgcacgtcggtccncgaggcctcgaggcgaagggctggcaggtggctggacctagtgtcgtggtcgtatagtaaagttngactagtactatgacagtacctgtcgnggacgggctagtcactctatctacgtagacactaacgtacgaacgtaccgtacggtacttaatcgtacgaacgtaaactacggtaacncggtaccgtagaaccgtaggtacggaacggg

SEQ ID NO: 148432 - DNA, 703 bp, Homo sapiens
  misc_feature: GYAE6OF02JJQ9Z.40.83.H06.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgcttcttttaagaggtgtccagtgtcaggtnctagttggtggagtcgtggggggagtcgtggtcccagcccgtggggacggtcatggaagtcctctccctgtgacagttccggtccggattccaccttcaattaaactataaacntcgacacgtcggtccgcaggcctccgaggccaaaggggcctggacaggtcggactggtcccacttcggtaccgttggggtaccgggtaattacggtaaaacgtttagtaccggtacctaaagttaccctaaggtccgaccgttaaggtacccgtttacgttccgttaccggggaggggttaccccgatttaccgattaccgtacgtttaccttaccgtaagtaacgaacgtaaacgtttaccgaaaacggtacccggtaaccggtacttttaaacgttacgtaacgtaaacccgtaattaaccggaaacgtaccggaccgttaggaaacccggttaggtacccgggaaggg

SEQ ID NO: 148433 - DNA, 684 bp, Homo sapiens
  misc_feature: GYAE6OF02G0CJB.40.83.H06.1.454.CMB.1.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (408)..(408): a, c, t, g, unknown or other
  misc_feature (408)..(408): n is a, c, g, or t
tcagtctagcgactcacgaccggtgctcgatttagatcacgtgcgtcgcggggtcgcggggctgccctttggtttggacgatggttttctcgatggggtctgggagaggagcccagcactcgaagtcggcggtgttgccattcggtgatcagcactgaacacagaggactcaccatggacgttgggctgagcttgggttttccncgttgcttctttaagnggtgtccagtgtcaggtnctaggttggtggagtcgtgggggagtcggtaggtccaggccgtaggggcgtacactgagtacctctcctaggtcgctacgtccggtaccggtattccaccttacaaataaagtactaacgattcgacctacgtcgggtcccacgaggtcctaccggagacgaaggggtcnggcgtaggtcggcgtcgggaccctacgttgtcgtcgggtacgtagtacgtaaagttgtacgactaagtaccgttagacgtcgtaagtccgttcgtcggtcgggaaccgggtacctacgttaccgtaacttccgtaacgttccgttaaccgtaagtaaccggtaactaaacgtttaaccgggaaacgtaaccgtacggttacctttaggtacccttagggaacctaaacgggtacaacgtaccggtaccgttaaggaacgttaccggaggtaaccgg

SEQ ID NO: 148434 - DNA, 774 bp, Homo sapiens
  misc_feature: GYAE6OF02J0KAF.40.83.H06.1.454.CMB.1.raw
  modified_base (220)..(220): a, c, t, g, unknown or other
  misc_feature (220)..(220): n is a, c, g, or t
tcagtctagcgactcacgaccggtgctcgatttagatcacgtgcgtcgcggggtccaaacagagcttcagcaagcatagtgggaatctgcaccatgccctggctctgctcctcctgaccctctcactcactctgcagttgtcagtcggtccaggcgagggctgactcgacgccctacccgtcgtgtaccaaggtacgttggacacgacccgtccactacnccaccgtgacaccgtaggaacctgaccggaataagtggttaccggaccgacccgtaaggacgcggtagcgtttacggcttcgacgtacggtaccgaacggttttacccggacccggaccggtccccctaaccgtaaaccctcccttcccgtaccccgtaccggtaaccggttcccggtaacccggtccggacccccgggttaccccgtaccgaaccggggttactacccgttaccgggaaacgtacggtaacggtactttaacgttcgtaacgccgttaactcccgggaagtttaccggaccgtaacctaccgaccgtacccgtacccgttaccgtaaccctaacgtacctaccgtacggtaccctacgtaccgaccgttaggaacgcggtacgtacgttacgtaccgttaacgttcgtacgttacgtacggtacgacgttacgggtaccggtacgtcccgtaagttacggtacgtaggttacgggtcggttacgggaccggtaacggtaccgaacggttccgaccgtaccgaggtaccgccgtaccgtaccgg

SEQ ID NO: 148435 - DNA, 631 bp, Homo sapiens
  misc_feature: GYAE6OF02JBZ8D.40.83.H06.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccacctcggtgtccaaggtacttgggacagaccgccacactcacctgcactgggacagcgacaatgtgcnccagancagctggctgcagcagtaccgagggcccgccctacccgaaacctccgtacctcccacgtacggtcctacggccgaccggcccctcgacgggactctaccgagtagaacgtatattcgtcgctactaccgaggttccgcgaacacgtacgcccttcctacgaccctagtaccgtactcggaaccttacgaacgtcctaaggacggacgacggacttaggaaccttacgttacttacggttaccgacgtacgtacggttcggggaccggtacgaacgttcccgtaaggtacttaggtaacggttggggtttaacggttccgggaacgggtaccggtaaacccgtacggttccggttacccgtacggtaccggtacgaccggtaacccgg

SEQ ID NO: 148436 - DNA, 566 bp, Homo sapiens
  misc_feature: GYAE6OF02IX7X6.40.83.H06.1.454.CMB.1.raw
  modified_base (177)..(177): a, c, t, g, unknown or other
  misc_feature (177)..(177): n is a, c, g, or t
  modified_base (291)..(291): a, c, t, g, unknown or other
  misc_feature (291)..(291): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagtctagcgactcacgaccggtgctcgatttagatcacgtgcgtcgcgggtccaaacagagcttcagcaagcatagtgggaatctgcaccatgccctgggctctgctcctcctgaccctctcactcactctgcagtgtcagtggtccaggcagggctgactcagccacctcggtntccaaggacttgggacacgaccgccacactcacctgcacgtggaacagcgaacaatgttcggcgccaaggagcagctggctgcagcagtaccagggccgccctccaaacgtccncctcccaacgcggtctcggccgtaccgccctacgacgggactcgtcgagagagactacttctagccaatccgaggttccacggaactacgacgccctacccgtanacccgatcctacgtggtacctacgaacncgttacgacgacgngactgtaactattacgtgtacgagctagcgggtacgactacggcctagacgttaggaacgttggggtacgttcgggacggtacggaaccgtacgtcggttaccgtccgtacggttacgacgtacccgg

SEQ ID NO: 148437 - DNA, 726 bp, Homo sapiens
  misc_feature: GYAE6OF02IK2IX.40.83.H06.1.454.CMB.1.raw
  modified_base (248)..(248): a, c, t, g, unknown or other
  misc_feature (248)..(248): n is a, c, g, or t
tcagtctagcgactcacgaccggtgctcgatttagatcacgtgcgtcgcggggtccaaacagagcttcagcaagcatagtgggaatctgcaccatgcccctgggctctgctcctcctgaccctcctcactcactctgcagtgtcagtggtccaggcagggctgactcacgccctacccgtcggtgtaccgaaggacgttagggacacggacccgccacactccacctgcacgtagggaacagacgaanatgttacggcgcccgaaggagcagctggcgtgcgagcgacgtaccgacggcccgcccctacccgaaactccctacctcccacgtacggtccgtacggccgtacccggcccctacgacgggactaccgtacgaacgaagagtacgttattccgtagctacgtacccgtacggttaccgaaccgtaacctaccgaacggtccccttacccgtaccgtaacctaccgtaccgtaaaccggtcggtaaccctacgaaaccggtccgtaagggaaccggacggaacgtcgtaacgaaccgtttagttaccgttagttaccgacgacgtacggttacggaaccggtcgaaccgttaccgtacgtaggtaacgttagggttacgggttaccgggttacggggtaaccggtaccgggtaaacccggtaaccgttcccgggtttaccggtacccggtttaacgggcccgtaaccggtaacccccggg

SEQ ID NO: 148438 - DNA, 645 bp, Homo sapiens
  misc_feature: GYAE6OF02JPZYW.40.83.H06.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
tcagtctagcgactcacgaccggtgctcgatttagatcacgtgcgtcgcggggtccaaacagagcttcagcaagcatagtgggaatctgcaccatgccctgggctctgctcctctgaccctcctcactcactctgcagtgtcagtggtccaggcagggctgactcagccaccctcggtgtccaaggcttgggacncgaccgcacactcacctgcactgggaacngcgacatgtgcgccaaggngcgagcgttaggctgaccgagtcgagtacccgngggcccncccctacccaaccgtcctcccgtacccaccgacggtcctcgggacccgtaccccggtcccctacggaagggaccttccgtacgaacggtacgaagtaccttgttaccgtacgtagaaccttaccgacgggttaccggaccaaacgtaccgaacgtcccctaccgtagaccccattacccggtacctaggacctacaaaccggtccgtaggaaccggacgtaacgggctacgtacttagttacctgttaccagtaccgtaggacgtcgacgtcgactccgagtggacggtagggtccgttagggccgggtaacggtaccgtacgttccggtaccggtacccgtacggtcccagggtaaccccg

SEQ ID NO: 148439 - DNA, 621 bp, Homo sapiens
  misc_feature: GYAE6OF02HP0OW.40.83.H06.1.454.CMB.1.raw
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgtcgcttcttttaagaggtgtccagtgtcgaggtgcaggttgggtggaggtcggtgggggggaggtcggtggtccaggccgtggggaggtcacgtggacgactctccgtggtcgcagtccgtccggtattccacccttaccaattaaactactaacatgactacgtcgggtaccgccacggcctccgaggaccgaagggactgcgtaggtcggctcggccctacgtgtccgtggtcggtagtaggtaaagttgtcgtactagtactagtacgctacgtactcgtcgtagggacgggtacctattccatctactctacgttaagacgtaaactaagttacgaacgacgtacgtacgttactacgtagaactaacgtacgaacgtacgtacctaacggacgtacggtacggaacggg

SEQ ID NO: 148440 - DNA, 686 bp, Homo sapiens
  misc_feature: GYAE6OF02GH88D.40.83.H06.1.454.CMB.1.raw
  modified_base (249)..(249): a, c, t, g, unknown or other
  misc_feature (249)..(249): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
tcagtctagcgactcacgaccggtgctcgatttagatcacgtgcgtcgcggggtcgcggggctgccctttggttttggagatggtttttctcgatgggggtctgggagaggagcccagcactcgaagtcggcggtgttgccattcggtgatcagcactgaacacagaggactcaccatggagtttgggctgagcttgggttttcctgttgcttcttttaaggaggtgtccagtgtcaggtgcagttggnggtagtcgtgggggagcgtggtccagccgtggggagtcacgtgagactctcctgtgcagtccgtcggtcttcctaccttaccaataaatanaacatcgctacgtcggtccnccgaggtcctccgaggacgaaggggactcggcgtaggtcggaccgtcggccctacgttggttaccgtcgggttcgggaagttaacggttaaaagtttcgtagacgtaacgttaccttaggtcgaccgttaacggaccttccgttacgggtacggggaaccgggtccgtaatttccgagttaccttagttaccttacgggtaagtaaacgtaaaccgttaaacgttaaaccggaaacgtaaccgtacggttaccgtttacgtaactacggtaacctaaagtacgtaaccgtcgtaccgacggtaaccgtagggtaccgaaaccgggg

SEQ ID NO: 148441 - DNA, 672 bp, Homo sapiens
  misc_feature: GYAE6OF02FZRV3.40.83.H06.1.454.CMB.1.raw
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggtagtttggctgagtcgttgggtttttcctggttgtcttacgttttaagaggttcgtcctaggtgtcgagggtgctaggttgggtggtagtcggtggggggaggcgtggtccaggccgtaggggacgtcactggagtcctctcgtgtgctgtccggtccgtacttccgtacccttacaattaaactataaacctatgtacctacggtcggtaccccgctaggtccctaccggagggtaccgaagggtactggaccgagggttcggcgtacggtacctacgttcggtacgttcgggtacgtaagttacggttaaagttataggtactaagttactagcgtacgtacgtaccgttcgtaccggtgggtaccgggtacttacgtcctagttacctacgttacttacgtagaacgtaacgtaacgtacgaacgtaccgtacgtacgttctacgtacaataacgacgaacgtacgtaccgtacgacgtacggagaacgg

SEQ ID NO: 148442 - DNA, 605 bp, Homo sapiens
  misc_feature: GYAE6OF02IJQU5.40.83.H06.1.454.CMB.1.raw
  modified_base (361)..(361): a, c, t, g, unknown or other
  misc_feature (361)..(361): n is a, c, g, or t
  modified_base (440)..(440): a, c, t, g, unknown or other
  misc_feature (440)..(440): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagaggtgtccagtgtcaggtgctagttggtggagtcgtgggggagcgtggtccagccgtggggacggtcacgtgagtactcctcctgtgctagtccgtccggtattccaccttccaataaatataacatgctacgtcgggtccncgaggcctaccgaggaccgaagggtctggacgaggtcggctcggcctacgtcgtcgtcggtacggtataggtaaagttntgactagtactagtgactacgtactcgtcgtgggacgggtcctattcatctaacttcgtacgagtaacgtaactaacgttacgaaacgtacgtaccggtacttaacgtcgttacaacgttaacgtaagaacctacgtcccgtaggaccgtaggaccgtaaccggg

SEQ ID NO: 148443 - DNA, 717 bp, Homo sapiens
  misc_feature: GYAE6OF02H3A5K.40.83.H06.1.454.CMB.1.raw
  modified_base (246)..(246): a, c, t, g, unknown or other
  misc_feature (246)..(246): n is a, c, g, or t
  modified_base (587)..(587): a, c, t, g, unknown or other
  misc_feature (587)..(587): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtggtccaggcagggctgactcagcccacctcgggtgtacccaaagggtaccgttggggaaccacggacccgcctaacactccacctggcaactgggaaaccnggctacaaagtcggttacggcgaccccgaaggacgacgacggtacgttcggcttaggccaggtaccgaaaccggttaaccgaaccggggtaccccggcccccgtaaccccgtaaaaaccgtccccgttaaccttcccccgaacgtaaaccggttccgttcggaccggtaaacccgggtccccgtacggacgggtactccgttacacggaacgacggtaatacgttctacggcatccgaggttcgacgaacacgacgccctccgtacgaccaatcaaccgtcggactcgaacgtctacggacggacgtaaggcgtagaacgttacttacgttaagccgtaancggtaacgttcggggaaccggcaaccgtcccgttagaacgggttcgaaacggtcggggttacggttccgggacgggaaccggtacgtaaacggtcgtacccggttacggtacgttaccgaggtaaccccg

SEQ ID NO: 148444 - DNA, 770 bp, Homo sapiens
  misc_feature: GYAE6OF02JLWH5.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtcgtcagtggtccaggccaggggctgactcgagcccacctcgggtgtccaagggtacttggggaccacggacccgcccaagcctcaccgtgacctacgtaccggggaacacggtaccgacgtaaagtggtttcggccgacccgtaaggacggcacggtcgttggacctcggacgacggcgtaacggcccggtaaccggggccccgtaccccttaacccctaaaccgtccccgttccgtacccccgacgtaccgggttaccgtcgggacccggtaacccgggtccctaccgggaaacgggtacctaccggttccgtaacggaacggtacggttaccttaggtttccgtacgtacccgtagttaccggtaaccgggtttccgaaccggtaacgtacccgtaccggtaccccttcccgtaccgtaaccctacgtacccgtacggtaccggtactacccgaacggttccggaacggtacgggtaccgacggtacgtacgtaccgttacgttacgttaccgtacgtacgaccgttacgcggggtaaccgcgtaaccgtccgaggtcgtacggtacggtggtcggtacggacgggtacgtaacgtacgtcgtacggtaccgtacggtcacgtaccgg

SEQ ID NO: 148445 - DNA, 692 bp, Homo sapiens
  misc_feature: GYAE6OF02F178L.40.83.H06.1.454.CMB.1.raw
  modified_base (366)..(366): a, c, t, g, unknown or other
  misc_feature (366)..(366): n is a, c, g, or t
  modified_base (434)..(434): a, c, t, g, unknown or other
  misc_feature (434)..(434): n is a, c, g, or t
tcagtctagcgactcacgaccggtgctcgatttagatcacgtgcgtcgcggggtcgcggggctgccctttggttttggagatggttttctcgatgggggtctgggagagggagcccagcactcgaagtcggcggtgttcgcctagttcggtgatcagcactagaacagaggaggacctcaccagtggtaggtttgggcttggagtcgtttgggtttttccctcggtttgtccttttacgtttttaaacggtggttcgtacctagttgttcgagggttgacgtaggtttgggtgggagttcgggtaggggggaggtcggttcggtccgaggtcccgtggggacggtcacgttggagtctctctgtcncgtagtccgtccgtacttcctaccctttacaattaaatactaactgtcgtcctaccggtcgggtcccngacggcctaccggagacggaagggctggcgagtcggcacggcctagtggtctagggtcgtagttaaggtaaacgtttgacgtactagttaactacgtcgactaacgtccttcgtaggtaccgggagggtaccttattcattcgtatccgttagagaacgtattaaccgtagaaccggtacctacggttccttaagtacgtaacaaacgtaacggtaccgaacgtccggaacccgttgaacggtacggtcggtaaccgg

SEQ ID NO: 148446 - DNA, 696 bp, Homo sapiens
  misc_feature: GYAE6OF02J1H1O.40.83.H06.1.454.CMB.1.raw
  modified_base (286)..(286): a, c, t, g, unknown or other
  misc_feature (286)..(286): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagctgggttttcctcgttgctcttttaagaggtgtccagttgtcaggtgcagttggtggagttctgggggagcgtggtccagcctgggaggtcatgngactctcctgacgtcactcgtccggattcacccgtttcacgttaaatactaacgatgacacgtgggtccgccaggcctaccaggtcaaggcgtgcgagtcggtactcggcccaacttcgtacgtgggtaccggtatacggtaaaagtttcgagtacctaacgttaaccttatgtaccgaaagttcccgttacgtacccgtaggggtaacggggtaaccttggtttaccttaaacggttcccttaacgtaccgttaacggttttaaccgaaacggttaccctaaaacgtttaaccgtaaacggtaaacccgtaacgggttaaccttttaacgttaacccgtgtaaacccgaaacgtttaacggaaacctaaccggtaccgtacggtaacctaagggtaccgaaacccgggg

SEQ ID NO: 148447 - DNA, 632 bp, Homo sapiens
  misc_feature: GYAE6OF02H8VWV.40.83.H06.1.454.CMB.1.raw
  modified_base (242)..(242): a, c, t, g, unknown or other
  misc_feature (242)..(242): n is a, c, g, or t
  modified_base (377)..(377): a, c, t, g, unknown or other
  misc_feature (377)..(377): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcttgggttttcctcgttgcttacttttaagaggtctccagttgtcaggtnctaggttggtggagttcggtggggggacgcgttcggtccgagtccgtggggaggtcacgtgacgtactctctggtcgcacgtcgtccggtattccaccttaccaataaactagtaacatcgctacgtcgggtccncgtacgcctccgaggacgaaaggggactcggacgtaggtcgcgtcggccagtcggttctagggtacgtaattaaggtaaacgtttagtacgtacgtaacttaactagtagaactcgtaactcgtacggtgggacgggtacctattactacgttctacttcgtacgaagtaactactaaacgttacgaacaccgtcggttatataccgtagaacttaaagtgaaccaaggtcctaacggacgtacgacggtaacgg

SEQ ID NO: 148448 - DNA, 684 bp, Homo sapiens
  misc_feature: GYAE6OF02JG7AZ.40.83.H06.1.454.CMB.1.raw
  modified_base (375)..(375): a, c, t, g, unknown or other
  misc_feature (375)..(375): n is a, c, g, or t
tcagtctagcgactcacgaccggtgctcgatttagatcacgtgcgtcggcggggtcgcggggctgccctttggtttggagatggttttctcgatggggtctgggagaggagcccagcactcgaagtcggcggtgttgccattcggtgatcagcactgaacacagaggactcaccatcggagtttgggctgagcgtggtttccgtcgttgctcctttaagaggtgtccagtgtcaggtgctaggttggtggagttcggtagggggaggtcgtgggtaccaggtcccgtggggacgggtcaccgtgaacgctctccgtgtagctatcgtccggtatccaccttccgaataactataacatcgcgtacgttgggtccncgacgctaccagggtcgaacggtactcgcgtagtcggcctacggccgtactgtcgtgggtacgtactacgaagttagtggacctaagtaccttagtacgtacgtaagggtcctcgttacccggtagggtcggggtacctacgttaccgtaacgtaccggttaccttaccgttacggtaacgtaacggtaacccgtaacgttaaccgaaacgggttaccgtaacgggtccctttaaaggttccgtacgtaaaccgtaacggttagaaacccggtacgtccgtaacgtaacgtacgggttaccgaaccggg

SEQ ID NO: 148449 - DNA, 870 bp, Homo sapiens
  misc_feature: GYAE6OF02GQB9W.40.83.H06.1.454.CMB.1.raw
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
tcagtctagcgactcacgaccggtgctcgatttagatcacgtgcgtcgcgggggtccaaacagagctttcagcaagcataggtgggaatctgcaccatgccctgggctctgctccgtcctgaccctcctcactcgactcctgcagtgtcagtggtccaggcagggctgactcagacccacccgttgggtcgtaccaaggacttgggacacggacccgccacgactcacgtcgacacgtgggaacnggcgacaattgttcggcaccaaggnacgagacttggactgacagcgaggtacccgacggggccccgaccccgtacccgaaaccttccctacctaccccaaccgtacggtaccgtaccggacccggtaacccccgtaccccgtacggaacgggtaccttaccgtaaccgaagggttaaacggtaacgtaaacgtttaacgtttccgtacgggaacctacggttaccccgtaagggggtttaccccgaaccggtaaacccgaccgtaacccgttcccccttacccgttaacggtaaccccgtaaacggttaccccgggtaaacggtttacgggtaaccccgttaaccgaaccgggtcccggtttaaaccgggaaccggggtaaccgttaaccgggttacctaccgggttaaaccttaacgttttaacccggtacggtttaaccgaacggttcccgttaaacgggtccgggggtaaccctccgtaaccgggtacccgtacggttacgggtacggttaaacgggttccggggtacccggttaccggggaaccggggtaaccggtaacccgtaaccgggtttccgggtaccccgttaccgggtaacggtccggtaacccggtaccccggg

SEQ ID NO: 148450 - DNA, 874 bp, Homo sapiens
  misc_feature: GYAE6OF02JBPF1.40.83.H06.1.454.CMB.1.raw
  modified_base (274)..(274): a, c, t, g, unknown or other
  misc_feature (274)..(274): n is a, c, g, or t
tcagtctagcgactcacgaccggtgctcgatttagatcacgtgcgtcgcggggtcgcggggctgccctttggtttggagatggttttctcgatgggggtctgggagaggagcccagcactcgaagtcggcggtgttgcctattcggtgatcagcactgaacacagaggactcaccatggagttggctgagcgttgggttttcctgttgcctttacttttaaggagggttgtccagttgtcgagggtagctaggttggtgacggtcggtgggggngtcgtggtccagtccgtgggtagtctacgtgacgactcctccgtggtctacgtagtccggtaccgtacttccaaccgtttccaaattaaagtactaaacgagtcgtacctacggtcgggacccgaccggtaccggtccctaccggaagggaccgaacgggggtctacgggactagggtcgggtaccgtcgggtacccttaccgtaggtttccggtacgggttaccgtaaggttaaacggttaaacggttaggtaccgtacggttaaacttaaccggttaacgtacggtaccgtaacggtttaccgtacccggtttaccggtaacgggggtaaacccggggttaccctttaacgtttacccgtaacgtttacccgttaccgtttaaccggttaaaccgggttaacggtaaaaccccggttaaacggtttaaaacccgggttaaccggtaaaaacccgggtaacgggttaaacccggttttaacgtttaaccggttaaggttaaacccggtaaacggtttaaacggtaacccggtaaacccggttaaccggttaccggtaaccgggtaaacccgttaccggtaacccgggggtaaaccgggg

SEQ ID NO: 148451 - DNA, 845 bp, Homo sapiens
  misc_feature: GYAE6OF02GGGA7.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcacgtgggaacagcgacaatggttgcgccaaggagcagcttggctgcagcagtaccgacgggccgcccctacccgaaacctccctacctccccacaggtcctcggccgacccggccctacgacgggtactccgtaccgaaggtaacggagtaactttactttccgacgtacctaacgttacccgtaacggggtttcccggaaccgtaaaccgtaccgtaaccgggtcccctaccccgttaccggaaccctaacttacccgtaacgtacccggggtaaaccttaacccgaaaccggtcccggttaacgggaaaccggggaaccggtaacgggtacccgttaacgggtaaaccttttaaacgtttaacccggttacgggtttacccgaacgggtaccgttaacggggttaccgggggtaaacccgggtccggtaaccgggtccccgttaacggtacgggtttaacggtaaacgggttttcgggggggtttaccgggtttaacccggggggaaacccgggggttaacccgggggtaaaaacccggttaaacccgggttttcccggggtttaaacccccgggttacccgggttttaaaccggggttacccggtaacccccggttaaaccccggg

SEQ ID NO: 148452 - DNA, 914 bp, Homo sapiens
  misc_feature: GYAE6OF02GPEC7.40.83.H06.1.454.CMB.1.raw
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcgttgggttttcctcgttgtcttacttttaagaggttgtcctaggttgtcgtagggtgcgtaggttggtgggtaggttcgggtggggggaggtcggtcggtaccgacggcccggtgggggacggttcgaaccgttaggacgtaccttccgttaccgttcggttacggtacctaacgttcccgggtaccccggtactttaccccgtaaccccgttttaccaaaactttaaaaacttaacctaaacgtaactacggtacccgtaaccggttcgggggtaccccgtacccgtaacgggtccccttaccggaacgggtaacccggtaaagggggtacccgtacggtaccggtaaggggtccggtacccggtccggggtaccctacggtttcgggttacggttacggggttaaccggttaaggttaaacgggttaaaacggttttagtaccgtaacgttaacgttaacggttaacgttacggaaccgttaaccgttacccgtttaccgttacgggttaccggggtaaccggggttacccgtaaccgttttaccgaacttacccgttaaccgtttcccgttaacggttaacggttaaaaccgaacgtttaaaaaccggtaccgtaaaacggacccggttaaccggttacttaaccgttacggtaacgtaaaaccgtaaacgtaacggaaccgtacgtacccgtaagtaccggtaccggtacggaacggg

SEQ ID NO: 148453 - DNA, 658 bp, Homo sapiens
  misc_feature: GYAE6OF02IFTSO.40.83.H06.1.454.CMB.1.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (474)..(474): a, c, t, g, unknown or other
  misc_feature (474)..(474): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcttgggttttcctcgttgcttcttttaagnggtgtccagtgtcaggtgctaggtttgggnggagtcggtgggggggacggtcggttcgggtccaggcccgtgggggacggtcacgtggacgtacttccttcctggtcgctacgttccgtccggtattccaccctttacaataaattataacagtcgctacggtcgggcccgcaggcctacgaggcgaacggctggactaggtcgcgttcggaccctagttcggtacgtgggtacggtataaggtaaagtttancgtactacgtactgtacgacgtagtccttacgtcggtacgggaccggggtaccttagttaccgtatcctacttcttacgtaagaactaacgtaaacgttaacgaaacgtacgttacggttacttcgtacgaacgaacttaaagtacgaacgtacgtaccgtacggtacgtacggacggaaccgg

SEQ ID NO: 148454 - DNA, 649 bp, Homo sapiens
  misc_feature: GYAE6OF02F00J8.40.83.H06.1.454.CMB.1.raw
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcacgcccaccctcggtcgtccaaggcttgggacacgaccgccacactcactgcacgtggaacagcgacaatcgtggccgcccgaaggngcagcttggctgcagcagtccgacgggcccnccctacccaaacctcccncctccccacgtacggtctacggcccgaccccggcccgtgacgggtactccgtaccgagaagagtaacttatttccgngtaccacgtcccgtagggttccgaacgaacccgtaactccgtccctacccgtnaaccctatccgacgtcggacctccgaacgtcgtagacggtaccggagaccgttagtaaccttacgtttaacgtcgttacgagtaccgtaaggccgggtaccgtcacgtcctagtacgggtagtacgggttggggtacgttaccgggggacggaacccggtaacgtacccgggtttcgacccggtttaccggacggtacccggtaccgtaaccccggg

SEQ ID NO: 148455 - DNA, 860 bp, Homo sapiens
  misc_feature: GYAE6OF02HEZ78.40.83.H06.1.454.CMB.1.raw
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccagttcggtgatcagcactgaacacagaggactcaccatggtagtttgggctggacgtcgttcggggtttttccctcggtttcggtacctttaccgtttttaaagggacggggtttcgttacccgtaagggttcggttaccggtaaggggttcgtaccggtaaggggttttcggggtggggttaacggtttccggggtgggggggggtaacggtccggggttacggggttaccccgtaacggggtccccggttagggggggaacggttacccgtaaaacggttcggaaaccggtaccctttccgttcccgttaggttccgaccgtaacggtttcccggtaccggttactttacccctaaccctttacgtaaaacgttaaacttaacgttaaactagtcggtacctaacggtttccggggaccctaccggacggttacctacccgggaagggtaccccggtaaaggggtacccttagggacggttacggttaccgggccgttacccgggtacctaacggttcggttacccggtggggttaacgtaaaccgttaaggttaaaacggtttctacgtactaacgtaagtcgacgtacacgtactcgtagtacgggtacgtcttaatcacgttactacgtagtacgagttaacagtaactacgaactacgacttagtacgtacgactaacaacgtcgaacctacgtcgtaacgacggtagcgtaacgg

SEQ ID NO: 148456 - DNA, 725 bp, Homo sapiens
  misc_feature: GYAE6OF02IO9YO.40.83.H06.1.454.CMB.1.raw
tcagtctagcgactcacgaccggtgctcgatttagatcacgtgcgtcggcggggtccaaacagagcttcagcaagcatagtgggaatctgcaccatgccctgggctctgctcctcctgaccctctcactcactctgcagtgtcagtggtccaggcagggctgactcagcccaccgtggtcgtaccaacggtcgttgggactacgaccgccacactccactgcacgtggaacagcgaactagttgtggccgaccgaaggcgcgtacgtcgttcggctgcacgtcgacggtacgaccgggtcccgacccctacccgaaaccgttcccttcccgtaccccgacggtacggttaccgtccgggaccgtacccggcccgtacgacgggtatccgtacgacggacgtacggtacttcgtttaccggacgacttaacggtacccgtagggtttacccgaacgtaccgtaacccgaccttacccgtacccgtaacggtaccctacgtacccgtaacgtaccggtaacctaccggtaaccgaccgttaaggggtaaccggacggtacggtctaacgtaaaccgtttacttaccgttaacgttcgaaccgtggtaacggttccggacgcgtccgtaccacgttacggagttccgggttgggtaccgggtaccggagggtaaccgtaacgtaccggttcggttacccggtcggtaaccggtcgtacccgtaccggg

SEQ ID NO: 148457 - DNA, 893 bp, Homo sapiens
  misc_feature: GYAE6OF02I40TN.40.83.H06.1.454.CMB.1.raw
tcagtctagcgactcacgaccggtgctcgatttagatcacgtgcgtcgcggggtccaaacagagcttcagcaagcatagtgggaatctgcaccatgccctgggctctgctcctcctgaccctctcactcactctgcagtgtcagtggtccaggcagggctgactcagccacctcggtgtccaaggacttgggacacgacccgaccactactcacctgaccacgtagggaacacgacgacaagttcggttcggccgacccgaaaggtcgaccgaggtccgttaggcctcggcgtagccgaacgttacccggacggggtaccccgtcccctaaccccgtaaaccttcccgtaccctacccgtaaccggtacgggttccgttaccgggaacccggtaccccgggtacccgtacggtaacggggtaccttaccggtacggtaaacggacggtaacgttaaccgtttaacgtttcggtacgtaccgtaccgttacccggtaaccgggtttaccggaaccgtaaacccgtaccggtaacccgtacccccggttacccgttaaccggtaacccttaaccgttaccgttaaccggttaccggggtaaccttaacccggtaaccggtacccggttaacgggtaaccggggtaacggttaccgggacctttaaccggaaccgttttaaccgtttaccggtttaaccgttaaccgtacgggtaaccggttacgggtaaccgggggttaccgaccccggttagtaacccggttggtaacgggttacggtacggggtttccggggttaaccggttcgggggtaaacccggggtaaccgtaaccggttaaccggttacccggttcccgggttaaccggtaacgggtccccggtacgggtaaccccgg

SEQ ID NO: 148458 - DNA, 752 bp, Homo sapiens
  misc_feature: GYAE6OF02GPTHU.40.83.H06.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggtagtttgggctgagctgggttttcctcgttgcttcttttaagnggttntccagtgtcgaggtgcgtagttgggtggagttcggtggggggaggtcgtggtccaggccgtgggaggtcacgtgactcgtctcgtgtgctagtccggttacggacttcctaccctttactaattaaagtataaactacgttacgcctacgtccgggtcccgccgtacggtccctccggaaggtacgaaggggaccttggacgtagggtcggtacgtccgggcctaacgttcggtaccgtttggggtacggtaagttaacggtaaaagtttcgtcggtaaccttagttaaaccgttagtacggacgttaactaccgttccgttaccggtaggggtaaccgggaccgttacttaaccgtacgttccctaaagttccttaacgtaaacgttaaacgaaccgttaaaccgttaacgggaaaaccgttaacccgtacgggttaacctttaccggttattaacccggtaacgtaaaccgtaccgaacgtaccggtaccgttaaccggacggtaccggtaacggtaaccccgg

SEQ ID NO: 148459 - DNA, 816 bp, Homo sapiens
  misc_feature: GYAE6OF02J2SYG.40.83.H06.1.454.CMB.1.raw
  modified_base (353)..(353): a, c, t, g, unknown or other
  misc_feature (353)..(353): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgtgccattcggtgatcagcactagaacacagaggactcaccatggtagtttgggctggagcgttggggtttttcctcggtttcgccgttagtttttaaaggagggttcgtccgaggttgtccgagggttcgctagggttggtgggtaggtccggtggggggacgtcggtgggtcctaggcccgtaggggacgtcacgtggacgacttcctcgtggtacncctagtccggtaccgtagttcctaccctttaccaaagtaaaagtacctaaacgtacgtacgaccgttaacccgttgggggacccctccggaaggacccgttaacccgggagggtaccgaaaacgggggtacttcgggtaactcgggggttaacggtcctaaccggggtccctaccggtttcggttcgttacgggggttaccgtaagtttaaggtaaaacggtttcgtcgggtaccctaagtttacgttaactcgggaactaaccggttccgtcgtccggggttagggacgggtacccgttagttacccgaacgttccgtacgtttccctaagggtaccgtaaaacgttaacgtacggttaacgtaacgaacgggacggttttaccttaaaggaccgttacggaaacttaaacgaccggtaacgtccgtacgtaaaccggtcgttaacggtaccgggtaaccgg

SEQ ID NO: 148460 - DNA, 822 bp, Homo sapiens
  misc_feature: GYAE6OF02GA59E.40.83.H06.1.454.CMB.1.raw
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcacatggagtttgggctgagcgttgggttttcctgttgcttacgtttaagnggtntccagtgtcaggtnctaggttggnggagtcgtgggggagcgtgtccaggtccgtgggacgtcacgtgacgtactctcctggtnctacgtcggtccggtattcccgacccgtttaccaaagttaaaactagtaaacctatacggtacctaaccgggttccggggtaccccgacccggtaagggtccctaccgggaacgggtaaccggaaaacggggggtccttacggacggtaacggttcggggtaccgtaaccggggtacccctaacgggtttacggttccgggttacggggttaaccggtaaggttaacggttaaaaaggtttcggtaacgtaccgtaaacggttaaccttacggtacgtaaccgtaacggttacccttcggttaaccggtacgggggtaaccgggttacccgtacgtttaacccgtacttacggtaaccgtttacccgttaaccggtaggtaaaccgtaaacgtttaaacggttaacccggaaaccgttaaccgttaccggtaacggtttaacctacgtaagtaacaaacggttaccgaacttaccggtcccggtaagtaaccggttacggtacgggtaacccgg

SEQ ID NO: 148461 - DNA, 686 bp, Homo sapiens
  misc_feature: GYAE6OF02JCP0F.40.83.H06.1.454.CMB.1.raw
  modified_base (222)..(222): a, c, t, g, unknown or other
  misc_feature (222)..(222): n is a, c, g, or t
  modified_base (342)..(342): a, c, t, g, unknown or other
  misc_feature (342)..(342): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatgggagtttgggctgagctgggttttcctcgttgcttcttttaagnggtgtccagtgtcaggtgcagttggtggagtcggtgggggagcgtggtccagccgtgggagtcactgacgctctccgtgcgcagtccggtccggattccgaccttcaataaatactaacnttgcctacgttggggtcccaccgaggtcctccgaggacctaaggggtactggactaggtcgccgtcgggccctacgttggtccgttcgggtacggtagtacggtaaaagtttcgtagtactacgttaacttaacgtcggtacgtaaccgtaaccttccgttacggtacggggtaccgggggtccgttaacgttacgaacgttcgtacgtttaacccgttacgtaacggtaacgtaaaccgttaaagtttacccggaaaactaccgtacgggttaccttaacggttcaacgtaactaagttaacgaaccgtaacgcccgttaagactaccgggttacgaaccggg

SEQ ID NO: 148462 - DNA, 879 bp, Homo sapiens
  misc_feature: GYAE6OF02HJA1B.40.83.H06.1.454.CMB.1.raw
  modified_base (206)..(206): a, c, t, g, unknown or other
  misc_feature (206)..(206): n is a, c, g, or t
  modified_base (857)..(857): a, c, t, g, unknown or other
  misc_feature (857)..(857): n is a, c, g, or t
tcagtctagcgactcacgaccggtgctcgatttagatcacgtgcgtcgcggggtcgcgggctgccctttggtttggagatggttttctcgatggggtctgggagaggagcccagcactcgaagtcggcggtgttgccagttcggtgatcagcactgaacacagaggactcaccagtggagtttgggctgaggcttcgggttttccncggtttgcctttacgttttaaggaggttcgtacctagttcgtcgagggttcgactaaggtttgggtggtaagtccgggttaggggggaacggtccggttcggtacccgacggtcccgttagggggaacggttccaacgtaggaaccggtaccttccgttacccgtggtacggaccgtaacgttccggtacccggttaactttcccgtaacccgttacctaaagttaaaaacttaacgtaaaccgtacgtttaccgaccgtaacccgttcggggggttacccccaccggttaaggtcccctaccgggaacgggtacgaaacggggtactcggtacgacggttcggacccgtaggtacccctagttccggtacgtaggggtaccggtaataacgggttaaaagttctaccgtaacgtaaaccgtttagttaaaccgtgggtaaaccgtacgttaacccgttacgggttcccgttaaagggggaccccgggtttaccgtaaacgttacccggaatttacccggtacccgtttagttaacccgttaagtaaacccggttaaattaaaccgtttaaaccgggaacgtaaacccggtccgttaacgttacgaacccgttagtaaaccgtaacgtaacgaacacccgtaaccggttanaaccggttacgaccggaaacgg

SEQ ID NO: 148463 - DNA, 728 bp, Homo sapiens
  misc_feature: GYAE6OF02JL5CE.40.83.H06.1.454.CMB.1.raw
  modified_base (272)..(272): a, c, t, g, unknown or other
  misc_feature (272)..(272): n is a, c, g, or t
tcagtctagcgactcacgaccggtgctcgatttagatcacgtgcgtcgcggggtcgcggggctgccctttggttttggagatggttttctcgatgggggtctgggagaggagcccagcactcgaagtcggcggtgttgccattcggtgatcagcactgaacacagaggactcaccatggagtttgggctgagcgttgggttttcctcgttgcttcttttaaggaggttcgtcagtgtcagggtgctaggttgggtgtaggtcggtagggggnggtcgtggtcctaggccggttagggaggtcctacgtggacgacttcgtaccgtggtacgactacgtccggtacggtacttaccctaccttacctaaactaaactagttaaccagtacgtctacggttccgggtccgacccggaggtaccgtaccggaagggaccgaaagggtaccgtcggaccgtaggtaccgtcgtaccgggcctaccgtcggttacgttcggggtacgtaaggttaaacgtaaaggttacgtagtacgtacttaacggttcgtacgtagtaccggtaccttcggttacggtaagggtcccgggtactacggttcctacgtactacgttacgtacgtaacgtactaaagttaactaaccgaaacggtaccaaccggttactttacgtacgtacgtaaactaacgtaaccgacgtacgtaccgtacgaacgtcggtacgtaacggg

SEQ ID NO: 148464 - DNA, 792 bp, Homo sapiens
  misc_feature: GYAE6OF02INU4V.40.83.H06.1.454.CMB.1.raw
  modified_base (230)..(230): a, c, t, g, unknown or other
  misc_feature (230)..(230): n is a, c, g, or t
  modified_base (454)..(454): a, c, t, g, unknown or other
  misc_feature (454)..(454): n is a, c, g, or t
tcagtctagcgactcacgaccggtgctcgatttagatcacgtgcgtcgcggggtcgcggggctgccctttggtttggagatggttttctcgatgggggtctgggagaggagcccagcactcgaagtcggcggtgttgccagttcggtgatcagcactgaacacagacggactcaccagtggtagttgggctgagtcgttgggttttcctcgttcgtcttacttttaaggnggtgtccagtgttccgaggtgcgtaggttggacggtagtcgggtgggggacgtcgtggaccgtgccggttaggggacgtccgtagtaggacgtccgttaccgtcgttcggtacgtcctaccggtttccggtaccggtacttcccgtaaccctttaccgaaattaaaacttaactaaacgtagtcgtaccgtacccggttcgggccccgtacggtaccggtaccnccggtacgggaaccgtacgggtacgtcgtaccgtagggttccggtacgtaccggtaccgtcgttcggttccggttagggttaccggtaaagttaacggtttaaacgttacgtacgtacttaaacgttacgtaaccggtcgtaccgttacggttacttccgtacgggtcgggaccgggtaccctacgtttaacgacgtaccgtacttacccgtacgaacggtactaaaccgtaaacggtacgaaaccggttacgtaccggttcttaaccttcgtaacgtaacgttaactacggaaccgtttccggaaccgttaccggacgtttaaccgggccgaacggg

SEQ ID NO: 148465 - DNA, 813 bp, Homo sapiens
  misc_feature: GYAE6OF02I9MFS.40.83.H06.1.454.CMB.1.raw
tcagtctagcgactcacgaccggtgctcgatttagatcacgtgcgtcgcgggtcgcgggctgccctttggtttggagatggttttctcgagtgggtctgggagaggagcccagcactcgaagtcggcggtgttcgccattcggtgatcagcactgaacacgagagactcaccagtggagtttggctgacgtcgttcggttttccgtcgttgtcttacgttttaaggaggttcgtccgtagtcgtcgtaggtgtacgtaggttgggtaggtacgttacgggtagggggtacggtccggttcggtaccgtacggtaccggtagggtacgtacgtaacgttcgaaaggtaccttacgtaccccgttagttacggcctaagttcccggtaccgggtaatttacccgaaacccttttcccgaaatttaaaactacgttaaaacctagttacggacctaaccgttacggggtaccctacccgtaaggtacccttacccggaggtacccgaaaaggggtacccttacggacctagggtacggtaccgttacgggaccctaacggttcgtaccgttacgggtaaccggtagtacggtaaaaggtttacgtagtacctaaagttacccgtaagtccgtacgtaacgtaccttacgtaccgtaggtaccgggaccgttaagtccgtaagttaccgagttacctacgtaagtaacgtaacgtaacgttacgaaacgtaccgtaacggttaccttaactcgtaacgtaacgtaaacgttaacgaacgtaccgtaccgtaacggtaaccgtacggttaccgaacgg

SEQ ID NO: 148466 - DNA, 824 bp, Homo sapiens
  misc_feature: GYAE6OF02JNSA2.40.83.H06.1.454.CMB.1.raw
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcaccagtggaggtttgggctgagcgttgggtttttcctcgtttgcttacttttaaggaggttntccagttgtcgaggtgcgaggttggtggagttcgtggggggagtcgtggtccnggccgtggggagtcacgtgacgacttcgtccgtggtcgacctacgtccggttaccggatttcctaacccgtttacaaagttaaatactaacatcgactaccggtgggtacccgccaggaccttaccaagggtcgaaacgggcctaggaccgtagggtacgcggtccggaccctacgttcgggttaccgttggggtaccggtaacgtttaagggttaaaaacggtttcgttacggtaacctaacggtttaaccgtaacggttacggtaccggtaacccggtttaacctacccggtttaacccgggttacggggtaacccgggggtaccgtttaactttacggttaaccttaacccggtaccgtttaacccgttaacgttaaaccgggtaaagtaaacccgtttaaacgttaacccggtaaaacggaacccggttaaaccgttacgttttaaaccgttaccgtaaggtaacccgttaaaaacgtcggtaaacgttaccggtaacccctaaggtaaccccgttacgggtaacggaaacccgg

SEQ ID NO: 148467 - DNA, 614 bp, Homo sapiens
  misc_feature: GYAE6OF02FJNRB.40.83.H06.1.454.CMB.1.raw
  modified_base (242)..(242): a, c, t, g, unknown or other
  misc_feature (242)..(242): n is a, c, g, or t
  modified_base (536)..(536): a, c, t, g, unknown or other
  misc_feature (536)..(536): n is a, c, g, or t
tcagtctagcgactcacgaccggtgctcgatttagatcacgtgcgtcgcgggggtcgcggggctgccctttggttttggagatggttttctcgatgggggtctgggagaggagcccagcactcgaagtcggcggtgttgccattcggtgatcagcactgaacacagaggactcaccatggagtttggctgagctgggttttcctcgttgcttcttttaaggaggttgtccagtgtcgaggtncgtagttggtggagtcggtggggggaggcggtcggtccagccgtgggacggtcactgacgactctctgtgctacgtcgtccggattaccacctttccaataaatataaacactagctacgtcgggtccgtaccgaggccctaccgaggtacgaagggtctggacgtacggtcggcgtcggaccctacgttcggtcgtcgggttacggacttagggaaatttagtcgacgtaacttacgttatagaccgtacgtacttctagggtcggacgggtccgtattcatcctattccgtntaagactactaagtacgaacacgtgaacttgactagtactaacgagtaacgcgtacccgtagacgtagtacggaacgg

SEQ ID NO: 148468 - DNA, 687 bp, Homo sapiens
  misc_feature: GYAE6OF02IFO4J.40.83.H06.1.454.CMB.1.raw
  modified_base (378)..(378): a, c, t, g, unknown or other
  misc_feature (378)..(378): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcaccatggagtttgggctgagcgttgggtttcctcgttgtcttcttttaaggaggttcgtccgtagtgtacctaggtgtctaggttggtggtacgtcggtgggggagtcggtggtccagccgtggggacgtcgtactggagtacctcgtccgtgtacgcctacgtcggtccggtacttccacgttaccaaattaagtactaacacgtnaccgtacggttcgggtcccaggtaccgtcctacgaacggacggaaacgggcttcgaacggcggttacggctccggacccgtagtccggtacggtggtacgaacgttaaggttaagttacgacgtagtacgttacgtacgtacgaccgtagtaccgttacgtacggtagggtaccgggtaccgttagtccgtaatccgtaacttacggtacctaagaccgtaacgtaacgtaacacgaccgtacgtactacttaacgaccgtaataacttaagaaccgtacgtaccgttacggaattcggaacggtacgg

SEQ ID NO: 148469 - DNA, 736 bp, Homo sapiens
  misc_feature: GYAE6OF02H1SMY.40.83.H06.1.454.CMB.1.raw
tcagtctagcgactcacgaccggtgctcgatttagatcacgtgcgtcgcgggggtccaaacagagcttcagcaagcatagtgggaatctgcaccatgccctgggctctgctcctcctgaccctctcactcactctgcagtgtcagtggtccaggcagggctgactcacgccacccgtcggtcgtaccgaaggtacttgggacacggaccgccacactccacctgcacgtacgggaacaggacgactaagttcggttcggaccgacccgaagggacgcacggtcttcggctcgacgagacgtacgtaccgacgggtacccgtacccctacccaacctccctaccgtaccacgtacggtccgcggaccgtcccggacctacggacgggtactaccgtacgacgagtaaggtatacgttcgtacgactacgtaccgaacgggtttaccgaccgtaaaccaccgaccggtaccccttaccgtaccgtaacctacgttaccgacgtaccggaccgtacgaacgtccgtaacggacgggtacgacggtactacgtaaccttacgttaccgttacggttacgacgacggtacggtacgggaaccggacgtaccggtaccgttacgtacggttacggttaacgggtcggggtttaccgggtcgggaaccggggtaacggtaacccgtaacggttccgggttacccggttacggtttaaccgggtcccgtaacggtaaccccggg

SEQ ID NO: 148470 - DNA, 752 bp, Homo sapiens
  misc_feature: GYAE6OF02IFHU9.40.83.H06.1.454.CMB.1.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (321)..(321): a, c, t, g, unknown or other
  misc_feature (321)..(321): n is a, c, g, or t
tcagtctagcgactcacgaccggtgctcgatttagatcacgtgcgtcgcggggtcgcggggctgccctttggttttggagatggttttctcgagtggggtctgggagaggagcccagcactcgaagtcggcggttgttgccattcggtgatcagcactgacacgagtaggctcacagtggtagttgggctgngtcttgggtttcctcgttncttnttttaacgagttgtccgagtcgtcaggtncgtagttggtggtacgtcgtggggacggcgtcggtccgacggtccgtgggacgtaccagtcggaagtcctccgttcngttgaacctgtccggtcggtacttaccgtacccgtttacaagttaaactagtaacgacctataccgtacgtcgggtaccgacctagggtccttaccgacgggtacgttaacggggccttggaaccttgggacggtccgtacggcccttagttacgggtgtcgggtagtaagtaacggtaagttgtacgtacgtacttacgtacgtgacgtacgtaccgttaccgtcgggtcgggtaaccgggtaccgttacgttaacctaccgttactaaccgttaccgtaaccgttaacgtaacgttaaccgttaaaccggtttaaccgtaaccgttaccggaccgtttacggtttaactaccgtttacggaaaccgttaacggtaacgtaaccggtacccggtttaacgtaccggtaacgtaccggttacggaaccggg

SEQ ID NO: 148471 - DNA, 772 bp, Homo sapiens
  misc_feature: GYAE6OF02F6NKM.40.83.H06.1.454.CMB.1.raw
  modified_base (141)..(141): a, c, t, g, unknown or other
  misc_feature (141)..(141): n is a, c, g, or t
  modified_base (522)..(522): a, c, t, g, unknown or other
  misc_feature (522)..(522): n is a, c, g, or t
  modified_base (627)..(627): a, c, t, g, unknown or other
  misc_feature (627)..(627): n is a, c, g, or t
tcagtctagcgactcacgaccggtgctcgatttagatcacgtgcgtcgcggggtcgcgggctgccctttggtttggatatggttttctcgatgggtctggagaggagcccagcactcgaagtcggcgtgtgccagttcggngatcagcactgaacacagagactcaccatggagttgggactgagcgttgggtttcctagtgcttctttaagcgtcgtcctagtgtcgagtgtcgtagtggtggacgtcggtcgggggatcggttcgggtccacggtccgtgggtacgtcacgttaggacgtaccgtctccggtgttccgcgtacgtccggtacccgtataccgtcccgttaccaaatataactacgtactagcctacgtcggacctcacgctaccgagctaagggctaggtctacggtacgccgttccggacctttaacgtccgggtttaccggtaggttaccgggtaaacttagggtaaaaacggtttcctacgggaaaacccttcggttaaccgtaacnccgggtaaggttccaccgttttaaccggacccggtaagggtacggggaacccttaacgttacccgttataccgtaagttttcctaaccggtaacccggtttaaanaaaccggttaacgttaacggaaaacccgtaaccgggtaccgtttacgaaccggtttaccggtaaacggttaacctaaacggtttacccgaacggttaacccgttacccggtaacgtaaaccgggtaccgggttaacccgaacggg

SEQ ID NO: 148472 - DNA, 689 bp, Homo sapiens
  misc_feature: GYAE6OF02HVHXW.40.83.H06.1.454.CMB.1.raw
  modified_base (254)..(254): a, c, t, g, unknown or other
  misc_feature (254)..(254): n is a, c, g, or t
  modified_base (515)..(515): a, c, t, g, unknown or other
  misc_feature (515)..(515): n is a, c, g, or t
tcagtctagcgactcacgaccggtgctcgatttagatcacgtgcgtcgcggggtcgcggggctgccctttggttttggagatggttttctcgatggggtctgggagaggagccccagcactcgaagtcggcggtgttgccattcggtgatcagcactgaacacagaggactcaccatggagtttgggctgagcttggggttttctcggtttgcttcttttaaggaggttgtccagtgtcaggtgctaggttggnggagtcgtgggggagcgtggtccagcctgggagtcagtgagactctccgtgtcgcagtcgtccggattccacctttccaataaatataaaccatgacctagttcgggacccctcgaaggtccctaccgaagggcaaacgggggtaccttggaaccagggttgggaccctcggggacccctaagtttcggggtttcctacgggggtcccggttaaataacgggttaaaaagtttcttgggaccaacgtttaaccttagtacncggtaacggtaccttcgttacgtagggacggggtcccctaagtttccaagttcctactaccgttactaaggtacccggaaataacgttaccgaaacgtacgtaggttaccttaagttccaggaacttaaagtgaaaccgtacggtcctacggaaaccgtggtaaccggaacggg

SEQ ID NO: 148473 - DNA, 741 bp, Homo sapiens
  misc_feature: GYAE6OF02IV7U3.40.83.H06.1.454.CMB.1.raw
  modified_base (260)..(260): a, c, t, g, unknown or other
  misc_feature (260)..(260): n is a, c, g, or t
  modified_base (271)..(271): a, c, t, g, unknown or other
  misc_feature (271)..(271): n is a, c, g, or t
  modified_base (423)..(423): a, c, t, g, unknown or other
  misc_feature (423)..(423): n is a, c, g, or t
  modified_base (680)..(680): a, c, t, g, unknown or other
  misc_feature (680)..(680): n is a, c, g, or t
tcagtctagcgactcacgaccggtgctcgatttagatcacgtgcgtcgcggggtcgcggggctgccctttggttttggagatggttttctcgagtggggtctgggagaggagcccagcactcgaagtcggcggtgttgccagttccggtgactcaagcactgaacacgagagactcaccagtggtagtttggctgagtcgttcgggttttcctcgttgtctttacgtttaaaggcggttcgtccgagttcgtacgaggtncgtaggttggnggacgtcggtgggggagtcggtggtaccaggtccgtgggtacgtcaacgtgaacgtccttcgtccgtgtcgtcctacgttccggtaccgtactttccgaccctttactaaagtaaactacgtaaccagtccgacgtacggttccggtacccncgtacggtccctacggaacgggtacgaaacgggactggaccgtggttacggccctcggggtaccctaggttcggtcggttacggggttacggaacgttaagggttaaacgtttgacggtactaaacgttacctagccgtaacgtacgttcctacgtacgtgggaaccggtccttagtacgtaacgttctcgttaaccgtataacgggtaaactaccgtaaagtaccgggaaactaacccggtacggttacgttaacnccgttaaagaacctaagttccggaaactcggtaccgtagtaaccgtacgggtacgaacggg

SEQ ID NO: 148474 - DNA, 785 bp, Homo sapiens
  misc_feature: GYAE6OF02G1340.40.83.H06.1.454.CMB.1.raw
  modified_base (669)..(669): a, c, t, g, unknown or other
  misc_feature (669)..(669): n is a, c, g, or t
tcagtctagcgactcacgaccggtgctcgatttagatcacgtgcgtcgcggggtccaaacagagcttcagcaagcatagtgggaatctgcaccatgccctgggctctgctcctcctgacccctcctcactcactctgcagtgtcagttcggtccaggcgagggctgactcgacgcccctaccgttcggtcgtaccgtaacggtacgttagggaaccacggaccccgacctaccaccctaccacccgtcgacctaaccggtacgggaaacctacggaccgtaaccgtaagttcggttccgggaccggacccccgaaagggacgaccgtaacggtccggtttacggccgtacggaccgtacggtaccgacggttacccggaccgggccccctaaccccgtaaccccgtaaccttcccctaccgtacccccgtaaccgtacggttccgtccggcccgtaccccgggcccgtacgacggtactccgacgagtacgtagtatacgtcgtgactaccgtaccgtacggttaccgaccgaacctacgtcccgccctaccgtacgaccctataccgtacgtacgacgtaaccgtcgcgttaacgagggtaccgaggtactacgttacttacgttagtaccgttacgacgtaccgagggttcgacccgtacgtaccgngtacggtacgtaacggtcggggttaacggttcggtacgggaacggttacccgggtaaaccgttaacggttcccgggttaccggttaacggaccggttacccgtacggtacccccgg

SEQ ID NO: 148475 - DNA, 752 bp, Homo sapiens
  misc_feature: GYAE6OF02F4O2Y.40.83.H06.1.454.CMB.1.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
  modified_base (432)..(432): a, c, t, g, unknown or other
  misc_feature (432)..(432): n is a, c, g, or t
tcagtctagcgactcacgaccggtgctcgatttagatcacgtgcgtcgcggggtcgcggggctgccctttggttttggagatggttttctcgatggggtctgggagaggagcccagcactcgaagtcggcggtgttgccattcggtgatcagcactgaacacagaggactcacatggtagttgggctgagcgttgggttttcctgttncgttactttaaggaggtgtccagtgtcaggtncaggttggtggtacgtcggtgggggagcggttcggccgagccgtgggacggtcacgtagacgtctccgtccgttgtcgctacgtccggtccggtacttccacctttaacaaattaaacgtaactaacatcgtccgtaacggtcgggttaccccgaccgacggtcctaccgaaggggtaccgaaacggggtcncgacgtaggtacggtccgtaggtaccctcggtagttccgggtacgggtacggtaagtttaaccggttaaaggtttacgtacgtacttaacgttaacgttaacggaccgaacgttaacgcccttttacgaccgggttaggggtacccggggtacctagttaccgttaaccttacgtactttaccgtagttaaccgaacgtaaaccgtaacggttaacctaaaccggtacgtaccggttaaccgttacgttaccgacggttaaaacctaagttaaccgaacggttacgaaccgtagtaaccggtaggttacccgggaaccgg

SEQ ID NO: 148476 - DNA, 690 bp, Homo sapiens
  misc_feature: GYAE6OF02I1NVD.40.83.H06.1.454.CMB.1.raw
  modified_base (216)..(216): a, c, t, g, unknown or other
  misc_feature (216)..(216): n is a, c, g, or t
  modified_base (512)..(512): a, c, t, g, unknown or other
  misc_feature (512)..(512): n is a, c, g, or t
  modified_base (676)..(676): a, c, t, g, unknown or other
  misc_feature (676)..(676): n is a, c, g, or t
tcagtctagcgactcacgaccggtgctcgatttagatcacgtgcgtcgcggggtcgcggggctgccctttggtttggagatggttttctcgatggggtctgggagaggagcccagcactcgaagtcggcggtgttgccattcggtgatcagcactgaacacagaggactcatcatggagtttgggctgagctggtttctcgttgcttactttaagngtgtccagtgtcgaggtgcgtaggttggtggtagtcggtggggggagcggtacggtccaggccgtgggagtcacgtgacgtactcgtccgtgtcgctacgttccgtaccggtacttacccgtacctttaccaaattaaatactaaacattccggactacggtcgggtcccacgacggtcctaccggaggaccgtaaacgggtctacggaccgttagggtccggtacgtaccggaccctagttccggttacgtcgggtacgtaagttaggtaaacgttgtacgacttaactagtacncgactaccgtacttcggtacgtacgggacgggacttacgttaccgtactaccgttattactaacgtaacgacgtaaacctaacggttaccggaaactaccgggttaaccgttgtacccgtagttacggaaaattaccgaacgttacggaacctaccgggttaanacgttaacggacgg

SEQ ID NO: 148477 - DNA, 776 bp, Homo sapiens
  misc_feature: GYAE6OF02IKPGP.40.83.H06.1.454.CMB.1.raw
tcagtctagcgactcacgaccggtgctcgatttagatcacgtgcgtcgcggggtcgcgggctgccctttggttttggagatggttttctcgatggggtctgggagaggagcccagcactcgagtcggcggtgttgccattcggtgatcagcactgaacacagaggactcaccagtggagtttgggctgagtcgttcgggttttcctcggtttgctttacgttttaaggaggttcgttccgaagttgtcgtaggttgcgtagggtttgggtagggaggttcgggtgggggagggtcggttgggtaccaggtccggtggggaggtccaacgtcggaacgtacttcctccggtagtcgacgtacgttccggtacccggtacttccgtaacccgttataaattaaaacgtataaacctagtccgtaccgtacgtcccggtacccgaccgacggtcccttacccggaggaaccgggacgggtaacctagggcctagggtccggcctaaccggggtcccctaaggtttcggtccggttaggggtaccgttaagtaggttaaacgttacgtagttacctaagttaaccgttagtacgtacgtaacgtaccgttccgttacgtaccgggtaacggtaccgttactacgtaaccgttactaccgttacgttaccgtaaaggtacgtaaacgtaacgttaaccgaaacgtaccgaaccgtttcgtaacgtacgtacgaactaagtacgtacctaacggtacccgtagacgtacggtaccgtaacgg

SEQ ID NO: 148478 - DNA, 702 bp, Homo sapiens
  misc_feature: GYAE6OF02JHIBR.40.83.H06.1.454.CMB.1.raw
  modified_base (513)..(513): a, c, t, g, unknown or other
  misc_feature (513)..(513): n is a, c, g, or t
tcagtctagcgactcacgaccggtgctcgatttagatcacgtgcgtcgcggggtcgcggggctgccctttggttttggagatggttttctcgagtggggtctgggagaggagcccagcactcgaagtcggcggtgttgccattcggtgatcagcactgaacacaggacgactccacgatggagtttgggctgagtcgttgggtttttcctcgttgccttcttttaaaggcggttcgtccagtgtcaggtgctaggttggtggagtcggtagggggagtcggtacggtccagccgttggggaggtccacgttgacgtaccttctccgtggtcgctagtccgtacgtcttccgacctttaccaattaaactacgtaaactgtacgccgtagttccgggtcccaccgtaggtccccgtcggaggtaccgaagggtcttgcgtaggttcggtcctacggtccctgttagtcgggttaggtggtaactagggtaaacttagcgaatacgtcttaacgngtacgacttcgttcgaggtcgggaaccgggtccttaacgttccttactacctacgttccggttaacacgtaaagttaaacccaacggtttaaaccaaacggttaccgtaacggtttactttaacgttaacgaacgtaactaaacggtacgttaacgccggtagtaccgaggttacgggtaaccaaccgg

SEQ ID NO: 148479 - DNA, 536 bp, Homo sapiens
  misc_feature: GYAE6OF01CP6RL.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctctttaagaggtgtccagtgtcaggtggaagtggtgcagtccgggggagcgtggtccagcctgggaggtccctgacactctcctgtgaagcgcctggactcaccttcagtggctatggccttcactgggtccgccaggttccagggcgaaggggctgggagtggttggctgatatatggtatgatggagagactaaacactttgcagactcgtggagggccattcacatcgcagagacaatccaagacacattgtatctgcaatagaacaactagacgaacccgaggacacgggtgtatattctgcgcgagagtagtgggggttcttaccggttggttcgggtaccttttcgttagttggtcgtgtcgggg

SEQ ID NO: 148480 - DNA, 533 bp, Homo sapiens
  misc_feature: GYAE6OF01EBMJL.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggaggcgtggtccagcctgggaggtccctgacactctcctgtgaagcgcctggactcaccttcagtggctatggccttcactgggtccgccaggttccaggcaaggggctggagtggtgctgatatatggtatgatggagagactaaacactttgcagactccgtgagggccgattcaccatcgccagagacaattccaggaacacattgtatctgacaatgaacaacctagacgacccgaggacacgggtgtatattctgcgagagagagtgggggttctacgttggttcgggtaccttttcgttatggtcgtgtacgggg

SEQ ID NO: 148481 - DNA, 613 bp, Homo sapiens
  misc_feature: GYAE6OF01BHZJK.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggccttcactgggtccgccaggttccaggcaaggggctgggagtggttggctgatatagtggtatgagtggagagaactaaactactttgacagtacctccggtggacgggcctatccacctacgtccgccaaggacactaactaccgaaggaaccactagttgtactcgtaggactaagtagaaccaaccgagaacggacccggaacggaccgtacgggtagtattacgttcgtcgcgacggaggaggtagggttcgggggttccttaccggtttcggggtttaccgggttaccttttaccgtttagtacgggtcgtcggtacccggggg

SEQ ID NO: 148482 - DNA, 568 bp, Homo sapiens
  misc_feature: GYAE6OF01D0GTR.45.39.D06.1.454.CMB.1.raw
  modified_base (479)..(479): a, c, t, g, unknown or other
  misc_feature (479)..(479): n is a, c, g, or t
  modified_base (488)..(488): a, c, t, g, unknown or other
  misc_feature (488)..(488): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtggaagtggtgcaggtccgggggaggcgtggtccagcctgggacgtccctgacactctcctgtgagcgcctggactcaccttcagtggctatggccttcactgggtcccgccaggtttccaggccaaggggctggagtggtggctgatatagtggtatgatggagagactaaactactttgacagactccggtggacggggctattccaccactcgccagagaactataccgaaggaacacattgtatcgtgacaatagaacaacgtagacgaccgagacgacggtntatattcgngcgacgagcgtaggttcggggttcttaccggttgggttaccgggttccttttaccgtttagtcggtcgttcggtacgggg

SEQ ID NO: 148483 - DNA, 552 bp, Homo sapiens
  misc_feature: GYAE6OF01B26AV.45.39.D06.1.454.CMB.1.raw
  modified_base (363)..(363): a, c, t, g, unknown or other
  misc_feature (363)..(363): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctggggaggtccctgacactctcctgtgaagcgcctggactcaccttcagtggctatggccttcactgggtccgccaggttccaggcaaggggctggagtggttggctgatatatggtatgatggagagactaaacnctttgcagactccgtgaggggccattcacatcgccagagacaattccagaacacattgtatctggcaatgaacaacctagacgacccgaggacgacgggtagtagtagtttctgccgcgagacgagtgggggttcctacgttcgggtttcggggtaccttttccgtttagtcggtcggttcgtcggggg

SEQ ID NO: 148484 - DNA, 868 bp, Homo sapiens
  misc_feature: GYAE6OF01EY28O.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggtagtttgggctgagtcttgggttttcctcgttgcttacgttttaaaggaggtgtccagtgtcgagggtggaagtggtgcgacgggtccgggggagcgtcggtccaggtccggtgggaccgtccctagacctaccttccgtccgtggtacggaacggtccgtccgtacggaccttaccctaacccgttcgtaaggtcggtaccttacggttccggtccctttaccggaccgggttccggggtcccctaccggttacggggttacccggaacggggacggggtaacgggggtcgttaggggtaggtttggggttacgtacgtaggttaattagttaggtacgggttataggtaacggttaggaagtaacggtaaaccttaacgttcgttaccgacggtaacggtacccgggtacggtaacggggaccggtaccgtaactaccgaacgtacgtacgaccgaagtaaccgtaaacgtaaccgtaaccgaacgaacttagttagttacgtacgtacgtaacgtaactaaccgtaacgaaaccgtacggaaccggtaacccggtaaccgggtaacggttacggttaccggttattacggttacgtcggtaggaccggtaacgggttaggtacggggtttacgggttttacccggggttaccgtttacccgggtttaccgggtttacccgtttaacccggtttggtaccgggtcgggtacccggtacggggtaaccccggg

SEQ ID NO: 148485 - DNA, 616 bp, Homo sapiens
  misc_feature: GYAE6OF01C2P2X.45.39.D06.1.454.CMB.1.raw
  modified_base (301)..(301): a, c, t, g, unknown or other
  misc_feature (301)..(301): n is a, c, g, or t
  modified_base (375)..(375): a, c, t, g, unknown or other
  misc_feature (375)..(375): n is a, c, g, or t
tcagacgcgatcgacacgaccggtgctcgatttagtgacatctcgagttctttggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggagcgtggtccagcctgggaggtccctgacactctcctgtgaagcgcctggactcaccttcagtcggctatggccttcacgtgggtccnccgaggttccaggcgaaggggctggagtggttggctggatatagtggtaatggagtgggaagagaacttaaacntttgcaagactccggtgacgggccattcacatcgacagacgaacaattaccaaggaacactagttagtacgtctcggacaagtagaaccaaccgtacgaacgaacccgaacggaacgaacgggtacgtatacgttcgtgaccggacgaggtacggtaggttcgggggttcgttacccgggttgggtttaccggggttaccctttttacgtttacggttcgggtacggtcggtaaccggggg

SEQ ID NO: 148486 - DNA, 809 bp, Homo sapiens
  misc_feature: GYAE6OF01AR1HT.45.39.D06.1.454.CMB.1.raw
  modified_base (179)..(179): a, c, t, g, unknown or other
  misc_feature (179)..(179): n is a, c, g, or t
tcagacgcgatcgacacgaccggtgctcgatttagtgacatctcgcagttcgtttgggggggagaggagcccagcactagaagtcggcggtgtttccattcggtgatcagcactgaacacagaggactcaccatggagtttgggctgagcttgggttttcctcgttgcttcttttaagnggtgtccagtgtcaggtggaagtggtgcgaggtccgggggaggcggtggtccgagtcccgtggggacgtccctggacctacgtcctccgtgtacgacgccgccgtggtaacctcctacccgtttcgaggttcggtacctagtcggtccctttacgacgttccggggtcccgccgtacggttcccgaggtaccggaagggggtccttggggtacggttgggtttggccgttagtaagttagttagtgggttagtaggtaggtacgggaagtaacgtaaaccgtaaaacgttacgtttagaccgtaaggtacccgttcgggtagggacccggggtacctacgttaccaacccgtacgtcggaccgtaacgaacgtaaccgtaaccgttaccgaaacgtaaactaccgtagtttaaccgtacgttaccgacggtaactaaacgttaacgaaacccgtaaccggttacggaaccgtaacccgggaacggtaaccggtaggtacgttacttacgtttacgcggaccggtaacggtagtaggggttacgggttaccgggggtttacgtttacccgggtttacgggtttacccgggttacctttttacggttcggttaccgggttcggttacccggg

SEQ ID NO: 148487 - DNA, 741 bp, Homo sapiens
  misc_feature: GYAE6OF01CY2S7.45.39.D06.1.454.CMB.1.raw
  modified_base (387)..(387): a, c, t, g, unknown or other
  misc_feature (387)..(387): n is a, c, g, or t
tcagacgcgatcgacacgaccggtgctcgatttagtgacatctcgcagttctttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtggagtggtgcaggtccgggggagcgtggtccagccgtgggacgtcctgacactctctgagagcgcctggactctaccttcagtggctatcggccttcacgtcgggtccgccgtacggttccaggcggaacggggtcgtagggacggtgggtttggctgatagtatggtatcgatgggaagagactaaacgtntttaggacaggtactccggtaggacggggtacccgtagttccgaaccgtaccttaccggacccgaacggaacgtaaccgtaaacgtttaccccgaaacgggtaaaccaaccgttagtttacgtaacgttccgtacgggtaacctaaagttacgaaacccgtaaaccgtacggaaccggaacccggtacgggaaccggtaacgggttagttaacgttacgttttacgtcggaccggtcggaaacggtaggttacgggttaggggggttttacccgttaccgggttttcgggtttacccgggggtttacccgtttttaccggttttacggttacggggttacccggtttaccgggg

SEQ ID NO: 148488 - DNA, 776 bp, Homo sapiens
  misc_feature: GYAE6OF01D9VDN.45.39.D06.1.454.CMB.1.raw
tcagacgcgatcgacacgaccggtgctcgatttagtgacatctcgcagttctttgggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtggaagtggtgcgaggtccgggggaggcgtggtccagccgtgggacgtccctgacactctcctgtagagccgtctggactcctaccttcagtggcttatcggtccttcacgtcgggtcccgccgtacggttccgagggcgaagggggccgtagggtacggttgggttcggctaggtatagttagtggtatgtagtgggaagtaacgtaactaaactacgtttcgacgtacggtaccgtacgggtacgggacggggtacccttaacgttaccaaccgtacgtaccggaccgtaaggaaccgtaactaaccgttaccgaaacggtaaccgtaacttaacgttgttactaccggtacggaacctaacgtaacggaaacccaaccgttacggaaaccgggacccggtaagggaacccgtaacggggttacttaacgttacgtttaccgtacggtaccggaggtaacggtacgggttacgggggtttccgggggtttaccgtttaccgggttttaccgggggtttacccgggttttacccgtttttaccgggtttaacggttccgggtaccgggtttacccggggg

SEQ ID NO: 148489 - DNA, 741 bp, Homo sapiens
  misc_feature: GYAE6OF01C0B9G.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagcttgggttttcctcgttgcttcttttaagaggtgtccagtgtcaggtggaagtggtgcgaggtccgggggagcgtggtccagccgtggggacggtcccctgactactctcctgtgaagcgcctggactccaccttcagtggcttagtcggtccttcgacgtcgggtcccgccgtacggttcccgaggaccgaacgggggcgtgggaggttgggttggcgttggaatagtagttggtagtgagtaggaagtaagtaaaccttaaactacgtttcgactaacgtaccgttccgggagggtacggggtccgtaacttaccgaacctaccgtccgtaaccgaaggaacgtaaactaacgtttaccgaaacggtaacctaacttagtttacgtactccgtaggaactaagtaacgaaacaaccgtacggaacggaacccggaacggaacgtacgggttagttacgttaagtttccgtcggaccgtaggtaaggtacggttagggtttccggggtttaccgtttacccgggtttacggggtttacccgggtttaccctttttaccggttaggtacgggttaccgggttcgggtaccgggg

SEQ ID NO: 148490 - DNA, 856 bp, Homo sapiens
  misc_feature: GYAE6OF01D3LC2.45.39.D06.1.454.CMB.1.raw
  modified_base (459)..(459): a, c, t, g, unknown or other
  misc_feature (459)..(459): n is a, c, g, or t
  modified_base (511)..(511): a, c, t, g, unknown or other
  misc_feature (511)..(511): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccagtggagttggctgacgtcgttcgggttttcctcggttgtcttacgttttaaggaggttcgtaccgaggttcgtcggagggtagggtaagtgggtcgcgacggggtcggggggacgggcggttcggtccacggccggttaggggaccggtccccgttaggacctaccgtccttccggtggtaggaacggccggtcccgttaggaaccttccgtaacccgttcgacggtcggtaccgtttacgtccggtccctttacgccggttaccggggccctaccggtacggtaccgaggtaccgggaacgggtcgtagggtcggtgggtacgtcgngtaacgttaagtgttaggtataggacgtagggtaacgaacgtaactaaaccnggtttacacggtacgtacggtcggtaggaacgggtaccggtacttaccgactacgccgtacgaaacggacgttaacaacggttaaccgaaacggtaactaacggtaacgttaaggtaccgttacgtaggaacctaacgtaacgtaaaccgtaacccggtaacggacccgaaccgggtaaccggtaaccgggtacggtacgttaaccgttgtacccgtgggtacccgagggtaaaccggtacggtagggtttacccggggttaccgttccgggttttagggtttaccccggggtttatttttacccggttaacgggtcggttaccggtccgggttaaacccggggg

SEQ ID NO: 148491 - DNA, 689 bp, Homo sapiens
  misc_feature: GYAE6OF01BOTUO.45.39.D06.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (254)..(254): a, c, t, g, unknown or other
  misc_feature (254)..(254): n is a, c, g, or t
  modified_base (347)..(347): a, c, t, g, unknown or other
  misc_feature (347)..(347): n is a, c, g, or t
tcagacgcgatcgacacgaccggtgctcgatttagtgacatctcgcagttctttgggggggagaggagcccagcactagaagtcggcggtgttccattcggtgatcagcactgaacacagaggactcaccatggagtttgggctgagctcgggttttcctcgttgcttacttttaagaggtgtccagtgtnaggtggagtggtgcagtccgaggggngcgtggtccagcgtgggacgtccctgactctctctgngagcgctgactccacttcagtgctagtcggccttcacgtcgggtcccgccgtaggttcccgagggcgaaggggctggggtacggttggtcggntgaagtctagtggtatgagtggagaagtaactaaacgtcttgactacgtacgtcggtgggacgggacccgtacttccgacctagtccgaccaggaaccgtacgtaaactcccgaacggtaaacaccgttagtttacgtacttcgtaggacctaagacgaaacctaaccgtacgaaccggacccgaggtaaccgtacgggtagttaacgtacgttttcgacggtacgcgggtaaagggttgggtaaggggtttccgggggtttacccgtttaccggggttttaccgggggtttaccccggggtttaacctttttcccgggtttaaggtcggggttaacccggg

SEQ ID NO: 148492 - DNA, 746 bp, Homo sapiens
  misc_feature: GYAE6OF01A8MZ9.45.39.D06.1.454.CMB.1.raw
tcagacgcgatcgacacgaccggtgctcgatttagtgacatctcgagttcgtttggggggagaggagcccagcactagaagtcggcggtgtttccattcggtgatcagcactgaacacagaggactcaccagtggtagtttgggctgagtcgttgggttttcctcgtttgcttacgttttaagaggtgtccagtgtcgaggtggaagtggtgcgaggtccggggagcgtggtccgagccgtgggacgtccctgacctactcctccgtagtagaacgccgtcccgtcggaccttccgtaaccttccgaggttcgacgttagtcgtccttaccgacgtcggtcccgccgtacggtcccgaggacggtagggtccgtggtacggtggtcgtgtagagttagtagtggtagtgacgtaggaagagtaaccgtaactgttagacctaggtaccgtccgtagggacggtaccgtactaccgaccgtacgtccgacgaagacgaactaacgtacgaacggaaactacgtattcgtacgtacgtagtactaacgtacgaacgtaaccgaacgtaacccggaaccggtaacgggtaacgttacgggttaacgttagttaacgtttacgtacggtacgaccgggtaacggtaagggttacggtttaccggggttccgttaccgggtttccggggtttaccggttttacccggttttacgttaccgggttacggttccgggttcggtaacccggggg

SEQ ID NO: 148493 - DNA, 798 bp, Homo sapiens
  misc_feature: GYAE6OF01BAQZF.45.39.D06.1.454.CMB.1.raw
  modified_base (182)..(182): a, c, t, g, unknown or other
  misc_feature (182)..(182): n is a, c, g, or t
  modified_base (384)..(384): a, c, t, g, unknown or other
  misc_feature (384)..(384): n is a, c, g, or t
tcagacgcgatcgacacgaccggtgctcgatttagtgacatctcgagttcgtttgggggggagaggagcccagcactagaagtcggcggtgtttccattcggtgatcagcactgaacacagaggactcaccagtggtagtttgggctgagtcgttgggttttcctgttgcttcgtttaaggnggtcgtccagtgtcgaggtggagtggtgcgtagggtccgggggagtcggtcggtccgagccggtagggacgtccctgaccctctccgtcctaggtacgacgccgtccgtacggaccttcaccgttcgaggtcggtactacgtcggtccttcgacggtcggtcccgtccgtacggtaccgaggcgggaaccgggtgtacgggngtgggttacgcgtagtatagtagttcgtagtgaggtacggaagtacgtaaactaacggtcttcgagtacgtcgtacggtggaacggtctaactcactacgtccgacgaagtacgaacgtacgttaccgaaacggactaacgtagtttacgtactcggtactaacgtaactaaccgtaaacccgtacggtaacgaacccgggaaccgggtaacggaaccggttacggttaacgttacgtttaaccgtcggtacggtaccggtacgggtaaacggttgggggtttaaaccggggtttacccggggggtttaccttttaccccggggggttttacgggttttaaccccgggttttaccggttttacccggtttaacgggtacgggttaccccgggtttagggggtaaaccccggggg

SEQ ID NO: 148494 - DNA, 838 bp, Homo sapiens
  misc_feature: GYAE6OF01EDWWL.45.39.D06.1.454.CMB.1.raw
  modified_base (188)..(188): a, c, t, g, unknown or other
  misc_feature (188)..(188): n is a, c, g, or t
  modified_base (196)..(196): a, c, t, g, unknown or other
  misc_feature (196)..(196): n is a, c, g, or t
tcagacgcgatcgacacgaccggtgctcgatttagtgacatctcgcgagttcgtttgggggggagaggagcccagcactagaagtcggcggtgtttccattcggtgatcagcactgaacacagacggactcaccagtgggtagtttgggctgaggtcttcgggttttcctgttgtcttacttttaagnggtgtccngtgtcgagggtggaaggtggtagcgtagggtcccggggaggtccgttcggtaccgaggtccgtacgggggtacgttacccctaggacctaccgttccgtccgtggtagaacgccgtcgtacggtccttacctaccgtttcgacggttacggtccgttagtaccggtccctttacggtcccggttcgggggtacccctccggttacgggttacccgacggggtacgggtaacgggggtccgttagggggtacgggtttcgggtttcgcgttagtaacgtttagttaggttcggtaagtggtacgtagggtaacggtaacgtaaacgtttaaacgtcgtttacgacgtaacggtaccgttccggacggggaccggggtacttacgtaccgtaaccgtcgaccggtacgaacggtaacgaaccttaagtacccgaaaggtaacctagttattacggtatcgagtacgtaatacgtaacctacggacgaccggtaccgtacgggacgtacgggttcgttaatccgttacgtcggacggtacgtaaggggtacggttcggggttcgggttacccggtttaccgggtttaccgggtttaccgggttttaccgttttggttacggttaccgggttccgggtaacccggg

SEQ ID NO: 148495 - DNA, 696 bp, Homo sapiens
  misc_feature: GYAE6OF01AM5X6.45.39.D06.1.454.CMB.1.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttccncgttgctcttttaagnggtntccagtgtcaggtggaagtggtgcaggtccgggggagcgtggtccagcctgggagtccctgacnctctcctgngagcgcctggactcaccttcagtggctatcggccttcacgtgggtcccgccgtagggtttcccaggcgaaggggctgggagtgggttggctgatagtactggtatgatggacgagactaaactcgtttgcagactccggtaggacggggtaccctagttacccaccgtacgtaccgacccgtaaggacgaacccgtaaacgttacccgaacgggtaaaccaccgtaagtttacgtaacgttacgttcggactaagtacgaaacctaaccgtaggaaccggaacccggaaggtaaccgtaaccggggttgtaacgttattacgtacggtccgacggaaggtaacgggtagggttacggggggtttaccttacccgggtttcgggtttacccggggtttaccgtttttaccggtttaacgtgggttcccggttgggtacccggggg

SEQ ID NO: 148496 - DNA, 847 bp, Homo sapiens
  misc_feature: GYAE6OF01CLK00.45.39.D06.1.454.CMB.1.raw
  modified_base (184)..(184): a, c, t, g, unknown or other
  misc_feature (184)..(184): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagtcgttgggtttttcctcggttgcttacgttttaaggnggttgtccagtgtacgaggtggaagtggtgcgaggtccgggggagcggtcggtccacggccgtggggacggtccctgacctactctcctgtgacgcgcctgactcctaccttcgagtggcttagtcggtacccttcacgttcggttcccgccgtaacgggttcccgagggccggtaaacgggggtcgtagggtaggtttcgggttggtacgttagaacgtttaagtagttgggttaagtcggtaggtagggaacgtaacggtaaaactaaaccgtttacgttttacggaccgtaacgggtaccccgttaccggggtaggggtaccggggtaaccctagtttaaccccgtaaccgtacggtacccgacccgtaaggaaccgtaaacccgtaaacgttacccggaaacgttaaccgaacttacgtttacgtacgttacgtacgaacgtaacgtaaccgtaaaccaaccgttaaggaccggaacccggtaacgggtaccggttaacgggttacgttacgttaaccgtttcggtaccggtcggtacggtaaaggtcggttaggggttcggggttttacccgttaccgggttttacggggtttacccgggttttacccgtttttacggtttacgggttaccggttacggttcccgggggttaaccggg

SEQ ID NO: 148497 - DNA, 782 bp, Homo sapiens
  misc_feature: GYAE6OF01AZZNI.45.39.D06.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (327)..(327): a, c, t, g, unknown or other
  misc_feature (327)..(327): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttccngttgctcgtttaagnggtgtccgagtgtcgaggtggaagtcggtgcgagggtccgggggagcggtcgtccagccgtggggacggtccctagacctactcctccgtgacgagtccgccgtaggacctcctacttcgagtcgctagtcggtcctcgtacgtcgggtaccnccgtacggttccgaggcggaaggggccgtgggtagtgggttcgcgtagtatagtagtggtagtgtagtaggaagtacgtaaactaaaccgtacgtttacggactaacggtaccgttccgggagggttaccgggggacctacgttaccgtaacccgacgtacccggacctaacggaacgtaacctaaacgttacccggaaagtaacccgtaacttactttaggtaacgtttcggtacggaactaacggtaacaaccgtaaccgtaggaacccgtaccgggaacgtaccggtacgggtttactagtttaccttcggcggtaaccggacggtaacggtacgggttcgggggttacggggttttacccgtttaccggggtttaaccggggtttcccgggtttttaacccttttacgggtttaccggtacgggttcccgggttcgggtaaaccccggggg

SEQ ID NO: 148498 - DNA, 163 bp, Homo sapiens
  misc_feature: GYAE6OF02F21IT.45.39.D06.1.454.CMB.1.raw
  modified_base (163)..(163): a, c, t, g, unknown or other
  misc_feature (163)..(163): n is a, c, g, or t
tcagacgcgatcgacacgaccggtgctcgatttagtgacatctcgcagttctttgggttttgggggaagaggaagactgacggtcctgccacagcggccctgggctgcctggtcaaggactacttcctactgctagtctgagcgggctggcaaggcgcatagn

SEQ ID NO: 148499 - DNA, 288 bp, Homo sapiens
  misc_feature: GYAE6OF02GJUCY.45.39.D06.1.454.CMB.1.raw
  modified_base (270)..(288): a, c, t, g, unknown or other
  misc_feature (270)..(288): n is a, c, g, or t
tcagacgcgatcgacacgaccggtgctcgatttagtgacatctcgcgagttctttgggggggttctaccttggttcggggaccttttcctttatggacgtctggggccaagggaccacggtcaccgtcacctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnnnnnnnnnnnnnnnnnn

SEQ ID NO: 148500 - DNA, 541 bp, Homo sapiens
  misc_feature: GYAE6OF02GPVM0.45.39.D06.1.454.CMB.1.raw
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggaggcgtggtccagcctgggaggtccctgacactctcctgtgaagcgcctggactcaccttcagtggctatggccttcactgggtccnccaggttccaggcaaggggctggagtggttggctgatatatggtatgatggagagactaaacnctttgcagactccgtgaggggccatcaccatcgccagagacaattccaggaacacattgtatctgcaatgaacaacctagacgacccgaggacgacgggtagtatattctgcgcgagagagtgggggttctaccgttggttcgggtaccgttttccgtttagtcggtacgtcgtcggg

SEQ ID NO: 148501 - DNA, 538 bp, Homo sapiens
  misc_feature: GYAE6OF02IJ0RA.45.39.D06.1.454.CMB.1.raw
  modified_base (338)..(338): a, c, t, g, unknown or other
  misc_feature (338)..(338): n is a, c, g, or t
  modified_base (400)..(400): a, c, t, g, unknown or other
  misc_feature (400)..(400): n is a, c, g, or t
  modified_base (468)..(468): a, c, t, g, unknown or other
  misc_feature (468)..(468): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggaggcgtggtccagcctgggaggtccctgacactctcctgtgagcgcctggactcaccttcagtggctatggccttcactgggtccgccaggttccaggcaaggggctggagtggtgctgatatanggtatgatggagagactaaacactttgacagactccgtgagggcattcaccatcgcagaganaactcagaacacattgtatcgtagacaatcgaacaacctgacgaccgaggacacgggtgtatacttcngcgcgagagacgtgggggttctaccgttgggttcgggtacctttttccgttagtggtacgtcgtacgggg

SEQ ID NO: 148502 - DNA, 721 bp, Homo sapiens
  misc_feature: GYAE6OF02JZ0U6.45.39.D06.1.454.CMB.1.raw
tcagacgcgatcgacacgaccggtgctcgatttagtgacatctcgagttctttggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggaggtccctgacactctcctgtgaagcgcctggactcaccttcagtggctatggcccttcactgggtccgccgacggttccaggcaaggggctcggagtggttcggctggatatagtggtatgagtggagagactaaacacgtttgacgagtactccggtaggacggggccgtagttccgaccacgtaccgaccgtaggaacggaactaacgttacccgaacggaaccgaacgtaacgtttcgttaacgttaccgttacggtacgtaaacgttaccggaaaaccgtaacccgtacggtaaccggaaccccggaagggaaccgttaaccggggttgttaacgttaacgtttacgttacggaccggtaccggagggtaacggtagggttacggggggtttacccgtttaaccggtttcggggttttacccggggttacccgtttttaccggttttaacggtttaccggggttaccggttaccggttaccggggg

SEQ ID NO: 148503 - DNA, 822 bp, Homo sapiens
  misc_feature: GYAE6OF02F7189.45.39.D06.1.454.CMB.1.raw
  modified_base (259)..(259): a, c, t, g, unknown or other
  misc_feature (259)..(259): n is a, c, g, or t
tcagacgcgatcgacacgaccggtgctcgatttagtgacatctcgagttctttggggggagaggagcccagcactagaagtcggcggtgtttccattcggtgatcagcactgaacacagaggactcaccatggagtttgggctgagctgggttttcctcgttgctcttttaagaggtgtccagtgtcaggtgaagtggtgcagtccgggggagcgtggtccagccgtgggacgtccctgaccactctcctgtgaagccnccgtggacctcaccttgagtggcttagtcggtcccttacacgttcgggtcccgcctagggttccaaggctaaggggcctgggaggttcggtggctaggacttagtacgtgggtatggagtacgggagtataacctaaaaccttgtttacgacaaacgtaccgtccgggttaagggacggggtacccgtaatttccgaaccgtacgtaccggtaccgtaacggaacggaaccgtaaacgttacccgaacggtaaacccgtaacgttaacgttacgttaacttacggttaaccggtacgtaaacgttaacggaaaccgtaaacccgttaggaacccggtaacccggaacgggtaaccggaacggggtttactaaacggtttaacttttaccggttacggtaccggtaccggtaacgggtaacgggttaacgggtttaccgggggggtttaacccgttttaaccgggtttacccgggggttttacccggggggtttaacccgtttttttacccggttttaagggtttacccgggtttaaccggggtttaccgggtttacccggggg

SEQ ID NO: 148504 - DNA, 1034 bp, Homo sapiens
  misc_feature: GYAE6OF02IR690.45.39.D06.1.454.CMB.1.raw
tcagacgcgatcgacacgaccggtgctcgatttagtgacatctcgtagtttcgtttgggggggacgaggagcccgagcactagaagtcggcggtgtttccagttccggtgatcgagccacgtgaaccacagaggactcaccgatcggaggtttgggctgagtcgtgggttttcctcgttcgcttcttttaacgaggttcgtcccagttcgttccgtaggtggaagtggtgcgtagggtccgggggagcggtggtccacgtccgtgggtacggtccccgtgaccgtaccgtccgtccgtaggtaggaacgccgtccgttggaccttcacctttcaggtggactacgtgggccctttcgacccgttacggggtccccgtacccgtacgggtttcccctaacggggtaccgtaaagggggggtcccttcgggggtaacgggttttccggggttttcgggttacccgttacgggttaaagttttaacgggtttaagggtttacggggtttaaacgttacgggttaaacggtttacggggggtaacggggtaaaccgggtaaacccgtttaaaaaaccggtaaccggttttttacggaaccgtaacgggtaacccgtttaccggggttaacgggtaacggggggtaccccgtttaacgtttcccgtaaacccgtaaaccgttaccccggtaacccgtaaacggtaaccggtaaaccgttaaaccgtttacccggaaacgggtaaacccgttaaccgttaacgtttaacggtttaactttaccgtttaacgggttaaccgtaaacgttaaccggaaacgttaacccggttaaggtaacccggtaaccccggtaacgggttaaccggtaaccggggtttaacggttaacggtttaacgtttaccgttacggacggtaaccggtacggtaacggttaacgggttacggggggtttaccgttaaccgggttttcgggttacccggggtttaaccctttttaccgtttaacggtttcgggttaccggttaccggttaaccgggg

SEQ ID NO: 148505 - DNA, 849 bp, Homo sapiens
  misc_feature: GYAE6OF02I7N6T.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggtttcctcgttgctcttttaagaggtgtccagtgtcaggtggaagtggtgcaggtccgggggagcgtggtccagccgtgggggtcgtccgtacgactcctcctcgtgtacgacgccgtccgtacgacctcctaccttcgtaggtcggcttaggcggttcccttacctacgggttccggggtcccctacccggttaccgggttaccggacgggtaacggggaacgggggtccggtaggggtagggtttgggggttccggtacgtggtaaagttagttaaggtttagggtaagttaggtaggtaggggaacgtaaacgtaaaccgtaaaacgttacgttcgacgtaacgtaccgtcggtaggggccgggacctacgtcaccgtacgtccgaccgaagacgaacgtaaccgtacgaaacggaactaacgtacgtttacgtacgttcgtaccggtaactaacgtaacgaaacctaaccgtacggaacccggtacccggggaacggtaaccgggtacgggttacgttaaacgtttatttaccgggtacgtaccggacgggtaacggtaacgggtttacgggggtttacgggggtttaacccgtttccggggttttaccggggggtttaaccccggtttttaacccggtttttaccggtttacgggtttacccggggttaccgggttaccgggtacccgggggg

SEQ ID NO: 148506 - DNA, 277 bp, Homo sapiens
  misc_feature: GYAE6OF02G4MXN.45.39.D06.1.454.CMB.1.raw
  modified_base (270)..(277): a, c, t, g, unknown or other
  misc_feature (270)..(277): n is a, c, g, or t
tcagacgcgatcgacacgaccggtgctcgatttagtgacatctcgcagttctttggggggggttctaccttggttcggggaccttttcctttatggacgtctggggccaagggaccacggtcaccgtcacctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnnnnnnn

SEQ ID NO: 148507 - DNA, 737 bp, Homo sapiens
  misc_feature: GYAE6OF02GM31L.45.39.D06.1.454.CMB.1.raw
  modified_base (395)..(395): a, c, t, g, unknown or other
  misc_feature (395)..(395): n is a, c, g, or t
tcagacgcgatcgacacgaccggtgctcgatttagtgacatctcgcagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcgaggtccgggggaggcgtggtccagccgtgggagtccctgacactctccgtgtgaacgcgcctggactccaccttcagtggctagtcggcctttcgacgtcgggtcccgccgtacggttccgaggaccgaagggggtcctgggtaggttgggttcggctaggtagttaagtagttggtagtgagtgggaanacgtaactaaactacgtttagacgtaagtactccggtaggacggggtacctagttaccgaacctagtcccgaccgaagacgaactaacgtaccgaacggaactaactagtttcgtacgttcgtaggactaaagtacgaaacctaccgtacggaaccgaacccggaagggtaacccgtaacgggtagttaaacgttcgttttacggtacgacggaccggtaagggtaacggttacggggtttccgggggtttaaccgtttacccgggttttaccggggtttacccggggttttacccgtttttacccggtttaacggtttacggggttaccggttacccgggg

SEQ ID NO: 148508 - DNA, 729 bp, Homo sapiens
  misc_feature: GYAE6OF02H0LYM.45.39.D06.1.454.CMB.1.raw
  modified_base (179)..(179): a, c, t, g, unknown or other
  misc_feature (179)..(179): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtntccagtgtcaggtgaagtggtgcaggtccgggggagcgtggtccagcctgggagtccctgacacgtctccgtgtgaagccgctggactcacctttcagtggctatcggccttcacgtgggtcccgcaggttccaggcgaaggggctggagtggtgctgatatatggtatgtatggagagtaactaaactacgtttagcgtaagaccgttccgtagggacgggggcctaacgtttccgaaccgtaacgttccggacccgaacggtaacggaaccgtaaaccgttacccgaaacgggaaccaaccgttaagtttacgtaacgttcgtacggtacgtaagtaccgaaactaacccgtagaaccggaacccggaacggtaaccgtaacggggttacgtaacgttaacgtttacgtcggaccggtacggacggtaacggtacgggttagggggggtttaccctttaccgggtttaccggggtttacccggggtttaacccgttttttaccggttttacgggttacgggtttacccggttacggttacccgggggg

SEQ ID NO: 148509 - DNA, 678 bp, Homo sapiens
  misc_feature: GYAE6OF02F5HBK.45.39.D06.1.454.CMB.1.raw
  modified_base (417)..(417): a, c, t, g, unknown or other
  misc_feature (417)..(417): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggaggtccctgacactctcctgtgaagcgcctggactcaccttcagtggctatggccttcacgtgggtcccgccgacggttccagggcaagggggctgggtagtgggttggcgtgatatagtggtatgatggagagactaaactactttgacagtactcgtggacggggccatcaccatcgcaganacaactccgaaggaacactattgtatcgtaggactaagtacgaaacctaaccgtacggaaccgacccggaacggtaaccggtaaccggggttaacgttaacgtttaacgttttccgtaggtaccggtacggtaagggtaacgggtacggggtttaccgggggggtttacccgttaacccgggtttcgggggtttacccggggtttaccccgtttttaccggtttacggtacgggttaccggttccgggttaacccgggggg

SEQ ID NO: 148510 - DNA, 659 bp, Homo sapiens
  misc_feature: GYAE6OF02IA5EL.45.39.D06.1.454.CMB.1.raw
  modified_base (174)..(174): a, c, t, g, unknown or other
  misc_feature (174)..(174): n is a, c, g, or t
  modified_base (359)..(359): a, c, t, g, unknown or other
  misc_feature (359)..(359): n is a, c, g, or t
tcagacgcgatcgacacgaccggtgctcgatttagtgacatctcgagttctttggggggagaggagcccagcactagaagtcggcggtgtttccattcggtgatcagcactgaacacagaggactcaccatggagtttgggctgagctgggttttcctcgttgctcttttaagnggtgtccagtgtcaggtggaagtggtgcaggtccgggggaggcggtggtccagccgtgggacggtccctgacactctcctgtgagcgcgtggactccaccttcagtggctatggtccttcacgtcgggtcccgccgtaggttcccaggtccggaagggggcgtggacggtgggttgcgtgattanagtggtatgatggagtacgataacatttgacagactcgtggagggcctattccaacatccgccaagagaactaactccgaaggaaccactaattacgtatacgtacggaacaagtacgaacaaaccgtaggaccgaacccggaacggaaccggtaacgggttacgtaaagttacgtttacgtcggtaccgacggtacggaaggttacgggttcggggggttacccgtttaccggtttcggggtttccggggttacccgtttttcccggtttaggtcgggttacggttccggtaccggggg

SEQ ID NO: 148511 - DNA, 735 bp, Homo sapiens
  misc_feature: GYAE6OF02HKKB3.45.39.D06.1.454.CMB.1.raw
  modified_base (175)..(175): a, c, t, g, unknown or other
  misc_feature (175)..(175): n is a, c, g, or t
  modified_base (313)..(313): a, c, t, g, unknown or other
  misc_feature (313)..(313): n is a, c, g, or t
tcagacgcgatcgacacgaccggtgctcgatttagtgacatctcgaggttctttgggggggagaggagcccagcactagaagtcggcggtgtttccattcggtgatcagcactgaacacagaggactcaccatggagtttgggctgagctgggttttcctcgttgctctttaagnggtgtccagtgtcaggtggaagtggtgcaggtccgggggagcgtggtccagcctgggacggtccctgacactctcctagtgaagccgacctggacctcgtaccttcgagtggactatcggtccttcacgtgggtcccncgacggttccgagggccgaagggggtctgggaggttggttggtcgtaggacttagtagttggtactggagtaggggaagaagtaacctaaaactcgtttacgctaagaccttccggtggacggggtccagttaccgaccgtacgtcggaccgagaacgtaactaaacgttaccgaaggtaaaccaacgtacgttaggtacttcggttacggactaagtacgtaaaccgtaaccgtacgggaaccggaacccgggaacggaacggtaaccggggttacgttacgttaagtttccgtacggacggtacggaagggtacggttacgggttcggggggtttaccgttaaccggttttcgggtttacccggggtttaccgtttttcccggtttacggttcgggttaccgggttcgggttaccggggg

SEQ ID NO: 148512 - DNA, 764 bp, Homo sapiens
  misc_feature: GYAE6OF02J2EBY.45.39.D06.1.454.CMB.1.raw
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagtcgtgggttttcctcgttgcttcttttaaggaggtgtcctagtgtcaggtggaagtggtgccgaggtccggggagcgtggtccagccgtgggacggtccctgacctactctcctgtagacgccgctgacctcaccttcgagtcggctagtcggtccttacgcgtcgggtcccaccggtacgtccgaggtcggaacgggtcgtagggtgtcgggttcgcttagaagttacgtggtaggtagtaggtaagtagggtaaagacgttaaaccgtaaaacgtcgtttagaccgtaacggtacccgtcgggtacgggaccggggtacctacgttcccaaccgtaagtcccgtaacgaacgtaacgtaacgtaaccgttacgaacggtaacctactagttacgttatccgtaacggaacctaagtaaccgtaaacgccggtaacggaacccgggtaacccggtaacggtacgtacggttaagttaaccgttacgttaccgcggacgtacggtaacggtaacgggttacgggtcgggtttaacccgtttacgggttaccggggttttaccggtttacctttaccggttttacgggaacggttcccgggttaggtaaccccggggg

SEQ ID NO: 148513 - DNA, 589 bp, Homo sapiens
  misc_feature: GYAE6OF02G24UK.45.39.D06.1.454.CMB.1.raw
tcagacgcgatcgacacgaccggtgctcgatttagtgacatctcgagttctttggggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctgggaggtccctgacactctcctgtgaagcgcctggactcaccttcagtggctatggccttcactgggtccgccaggttccaggcaaggggctggagtggttggctgatatagtggtatgatggagagactaaactactttgacagtactccgtaggaggggccgattcacctatcgcagacgacataccaggaacacattagtatctgacaatacgaacaacgtacgacgaccgaggacgtacgggtacgtagttattcgtgcgacgaggagtaggttcggggggttcgttaccggtttcgggttaccggggttacccgtttttaccggtttacgtcgggtacggttcggtacggggg

SEQ ID NO: 148514 - DNA, 782 bp, Homo sapiens
  misc_feature: GYAE6OF02GGWIY.45.39.D06.1.454.CMB.1.raw
tcagacgcgatcgacacgaccggtgctcgatttagtgacatctcgcagttctttgggggggagaggagcccagcactagaagtcggcggtgtttccattcggtgatcagcactgaacacagaggactcaccatggagtttgggctgagctgggttttcctcgttgctcttttaagaggtgtccagtgtcaggtggaagtggtgcaggtccgggggaggcgtggtccagcctggggacggtccctgacactctcctgtgaagcgcctggactcaccttcagtggctatggccttcactgggtccgccgaggttccaggcgaaggggctgggagtggttggctgatatatggtatgatggagtagactaaacactttgcaagtactccggtaggacgggggtaccctagttaccaaccgtaacttccgacccgtaacggaacggtaaaccgtaaacgtttacccgaaacgggaaaccctaaccgtaacggtttaacggttaacgttccggttaacgggtaaccgtaaaacgttaacggtaaaaccgtaaacccgttaagggaaaccggtaaaccccgggaacgggtaaaccggtaaccgggggttacgttaaacgtttaacgttttaccgtacgggaccggtacgggtaaggtaacgggttaagggtttaccggggggggttttacccgtttaacccgggttttacgggggttttacccggggggtttaacccgtttttttaacccggttttaacggtttccggggttacggtttacccggggg

SEQ ID NO: 148515 - DNA, 855 bp, Homo sapiens
  misc_feature: GYAE6OF02HCCGK.45.39.D06.1.454.CMB.1.raw
  modified_base (286)..(286): a, c, t, g, unknown or other
  misc_feature (286)..(286): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagcttgggttttcctcggttgcttcttttaagaggttgtccagtgtcaggtggaagtggtgcgaggtccgggggaggcgtggtccaggccgtgggacggtccctgacctactctcctgtacgaagcgctggactcaccttnagtggctagtggtccttcacgtcgggtcccgtccgtacgggttcccgaggtcggaaacgggggtccgttagggaggtttggggtttggaccgtggtaacgttattaaggttacgggttaagtggtaaggttaggaagggtaacgtaaaccgttaaaaaccgtacgttttaggaaccgttacgaacccgtttacccggggtagggtacggggggtcccgttaaagttcccgtaacccgtactacccggaccgtaacgggtaaaccgtaaaccgtaaaccgtttaacccgaaacgggaacctaaccgtaacgttttaggtaaccgttcgttaacgggaccgtaaacgtaacggtaaaacccgtaaacccgtaacgggtaaccgaacccgggtaacggaaccggtaaccggggttaacgttaacgtttaacgtttcggtccggtacgacggaaggtacgggtacgggttaggggggtttaaccctttaccggttttacggggtttaccccgggttttaccgttttttaccggtttacgggttacgggtttaccggttaccgggttacggggg

SEQ ID NO: 148516 - DNA, 886 bp, Homo sapiens
  misc_feature: GYAE6OF02GJNGA.45.39.D06.1.454.CMB.1.raw
  modified_base (63)..(63): a, c, t, g, unknown or other
  misc_feature (63)..(63): n is a, c, g, or t
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
tcagacgcgatcgacacgaccggtgctcgatttagtgacatctcgcagttctttggggggganaggagcccagcactagaagtcggcggtgtttccattcggtgatcagcactgaacacagagactcacatggagtttggctgacgcgttgggttttccngttcgaccttacgttttaaaggnggttcgtcctagttcgtacgaagggttaggaagttggtcgcgtaggggtccggggagcgttacggtccgacggccgttagggacggtcccctaggacctcttcgtccgtggtacgaacggccgtccgtacggaccttaccacgttcgtaggtcgtacctatcggtacccttgaccggttcgggtcccgacgttaggtcccgaaggtccggaagggtccttaggacggttcggtcggtactaacggtacttaacggttaacggtaggtttagcgtaaggtacggaacgtaaagttaacccttaaagttccgtttacgaacgttacggtaccgtttaacgggtacggggaaccgggttaccctacgttacccgtaacgtaccggttaccggtaccgaaacggtaacgtaaacggttaaccgtttaaccggaaccgggtaaactaaccgttagggtttaaccgtttaacgggacgttaacggttactaaaccgggttaccgtaaaaccgtacgtaccgggtaaaacccgttaaccgggaaaccgggttacggttaaacccgggttaagtttaccgttaacggtttccccggttaaggccgttacggtaacgaacgggtttacggggttacggttacccgttacgggtttacgggtttacccggttttccgttttaacggtcgtttaccgggacggtttaacccggg

SEQ ID NO: 148517 - DNA, 935 bp, Homo sapiens
  misc_feature: GYAE6OF02GK0ST.45.39.D06.1.454.CMB.1.raw
  modified_base (179)..(179): a, c, t, g, unknown or other
  misc_feature (179)..(179): n is a, c, g, or t
tcagacgcgatcgacacgaccggtgctcgatttagtgacatctcgagttctttgggggggagaggagcccagcactagaagtcggcggtgtttccattcggtgatcagcactgaacacagaggactcaccatggagtttgggctgagctgggttttcctcgttgcttctttaagaggtntccagtgtcaggtggaagtggtgcaggtccgggggagcgtggtccaggccgtgggacgtccctgaccacctcctctgtagaacgcgccgtggacctcaccttcgagtcggactagtcggtcccttcacgttcggttcccacgtaggttcccgaggtacggaaggggtccgtggggtacggtttgggttcggtactaggtaacgttaacgtaggttacggtagtcgggtagtaggggaaacgaaacgtaaaccgttaaaacgttacgtttacgaaccgtaacgttaacccggttccgggtaacgggggaaccggggtaccctaacgtttaccccgaacccgtaccgtacccgggtaacccgaaacgggtaaacgtaaacccgttaaaccgttacccgggaaaacggtaaacccgaaccgtttaaaggttttaccgtaacgttacccggtacgggtaaacctaaacgttaaccggaaaacccgtacccgttaacgggaacccggaaaccccgggttaagggaacccggtttaccggggtttaagttaaacgtttaacggtttccggaacgggttacccgtaacgggtaacgggttaaccgggttaaccgggggtttttccgggggtttaaaccccgttttacccggggtttttacccggggggtttttaacccccgggttttaaccccgtttttttaacgggttttaccggggtacccggggttttacccgggtttaccggggttaaaccccgggggg

SEQ ID NO: 148518 - DNA, 737 bp, Homo sapiens
  misc_feature: GYAE6OF02I40E4.45.39.D06.1.454.CMB.1.raw
  modified_base (157)..(157): a, c, t, g, unknown or other
  misc_feature (157)..(157): n is a, c, g, or t
  modified_base (171)..(171): a, c, t, g, unknown or other
  misc_feature (171)..(171): n is a, c, g, or t
tcagacgcgatcgacacgaccggtgctcgatttagtgacatctcgagttctttggggggggagaggagcccagcactagaagtcggcggtgtttccattcggtgatcagcactgaacacagaggactcaccatggagtttggctgagctggtttccngtgctcgtttaagnggtgtccagtcgtcgaggtggaacgtggtgcaggtccggggagcgtggtccagcgtgggagtcccgtagacactcgtccgtgagagccgccttaggctactaccgttcaaggtcggactacgtcggtacccttcgacgtcggggtacccgtccgtacggttacccgaggtaccggtacggggtcgttcgggaaggttcgggttggtaccgtggtaacttagtaacggtggttaacgtacgtaaggttagggaaactacgtaaaccgtaaaccgttacgtttacgacgtacgtaccggttcggtaacggaccggggttacctacttacccgaccgtataccggtaccgtaacggtaacgtaaccgtaactaccggtaacggaacctagtagttaacgtagtcgtacggaactagtacgaacgaacgtacgaccggaaccgaacggacgtacgggttataacgtttctaccgtacgaccgtaggaggtaacggtcgggttacgggttacgttaaccggtttcgggtacggttaccttttacggtacgtcggtacggtcgtaaccgggg

SEQ ID NO: 148519 - DNA, 339 bp, Homo sapiens
  misc_feature: GYAE6OF02FPBN1.45.39.D06.1.454.CMB.1.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (293)..(339): a, c, t, g, unknown or other
  misc_feature (293)..(339): n is a, c, g, or t
tcagacgcgatcgacacgaccggtgctcgatttagtgacatctcgcagttctttggggggggttctaccttggttcggggaccttttcctttatggacgtctggggccaagggaccacggtcacgtcacctcagcctccaccaagggcccatcggtcttccccctggcgccctgctccaggagcacctccgagagcacgagccggaccctgggctgccgttgggtcaaggtactacttccgtcgattcgccgtcttggaggcgggtctggccaaggggtcgntacgtagcngnnnnnnnnnnnnnnnnnnnnnnnnnnnnnnnnnnnnnnnnnnnnnnn

SEQ ID NO: 148520 - DNA, 560 bp, Homo sapiens
  misc_feature: GYAE6OF01AP1PZ.19.2.A02.1.454.CMB.1.raw
  modified_base (309)..(309): a, c, t, g, unknown or other
  misc_feature (309)..(309): n is a, c, g, or t
  modified_base (544)..(544): a, c, t, g, unknown or other
  misc_feature (544)..(544): n is a, c, g, or t
tcagtactctcgtgcacgaccggtgctcgatttagactcatctacagggtctccgaaggctttaacagtcctgtcccaggtgcagctacagcagtgggcgcaggactgttaaagccttcggagaccctgtccctcacctgcgctgtctatggtgggtccttcagaggttactactggagttggatccgccagcccccagggaagggactggagtggattggggaaatcaatcatagtggaagcgccagctacaacccgtcctcaagagtcggctcgacatattagtagacacgcccaagagtcagttcnccctgaagctgggctctgtgaccgccgccgacacggctgtctatttctgtgcgagagttggattattgtgctggtgtagctgctacgcgtcgtttcagttagacttacgtggggtcagggtaaccctggtccaccgttctcctcgacgccctccaccgtaacgggccctagtccggtccttcccccgtggcccgtccctcgcccgtccgaggcgccacccgtccgagacgccacncggccggcccgtcggg

SEQ ID NO: 148521 - DNA, 543 bp, Homo sapiens
  misc_feature: GYAE6OF02FWFLQ.19.2.A02.1.454.CMB.1.raw
  modified_base (452)..(452): a, c, t, g, unknown or other
  misc_feature (452)..(452): n is a, c, g, or t
tcagtactctcgtgcacgaccggtgctcgatttagactcatctacagggtctccgaaggctttaacagtcctgtcccaggtgcagctacagcagtggggcgcaggactgttaaagccttcggagaccctgtccctcacctgcgctgtctatggtgggtccttcagaggttactactggagttggatccgccagccccagggaggactggagtggattggggaaatcaatcatagtggaagcgccagctacaacccgtcctcaagagtcggctcgacatacttagtagacacgcccaagagtcaagttctccctgaagctgggctctgtgaccgccgccgacacggctgtctatttctgtgcgagagttggatattgtgctggtgtagctgctacgccgtcgtttcagttagacttacgtggggtacagggaccctggtccaccgtctcctcncgtcctccacgacggccagtcgtccttcccgtgccgcctgcctccgaggtacgcctaccgtccggagcgccaccgacggccggccctcggg

SEQ ID NO: 148522 - DNA, 723 bp, Homo sapiens
  misc_feature: GYAE6OF02FK4RO.19.2.A02.1.454.CMB.1.raw
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
tcagtactctcgtgcacgaccggtgctcgatttagactcatctacagggtctccgaaggctttaacagtcctgtcccaggtgcagctacagcagtgggcgcaggactgttaaagccttcggagaccctgtccctcacctgcgctgtctatggtggtccttcagtaggttactacgtggagttggatccgccacgccccgagggaggactggagtggagttggggaaatcgaactcagtaggtggaacgcgccagctaccgaacccgtcctacgaanacgggggggggtcncgtcgacatattagtacgaccacgcccaagacgtcgtacgttcctccctagaacgcgtgggacctcgtcgtacgacccgccggtaccgaccgtacggcgttcgtacgtttacgtttccgtgttacggacgtagtacggttggtattagttcggttgtcgttagggttcggtaggtccgttaggcctaccggtccgtacgttttcgaacgttacgtacgttacggtcgggttacgaacggtacccgttcggtaccctccgttccgtcccgtacgtaccgtcccgtacccaacccgtaaccggtaccctacggttccccgtacccgtttcccgtaccgcccgttacccgtcgtcccgtaccggaccggtccggacccgttcccgtaccgggacgtaccggtacccgaccggccggacccggtcccggttcccggg

SEQ ID NO: 148523 - DNA, 204 bp, Homo sapiens
  misc_feature: GYAE6OF01DI5WE.42.14.B03.1.454.CMB.1.raw
  modified_base (203)..(204): a, c, t, g, unknown or other
  misc_feature (203)..(204): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggcctgggctgcctggtcaaggactacttccacatacgtcactgagcgggctggcaaggcgcatagnn

SEQ ID NO: 148524 - DNA, 207 bp, Homo sapiens
  misc_feature: GYAE6OF01DB521.42.14.B03.1.454.CMB.1.raw
  modified_base (206)..(207): a, c, t, g, unknown or other
  misc_feature (206)..(207): n is a, c, g, or t
tcagtgacgtatgtcacgaccggtgctcgatttagtgtgagtagtttggaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 148525 - DNA, 215 bp, Homo sapiens
  misc_feature: GYAE6OF01ATTP2.42.14.B03.1.454.CMB.1.raw
  modified_base (205)..(215): a, c, t, g, unknown or other
  misc_feature (205)..(215): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnnnn

SEQ ID NO: 148526 - DNA, 205 bp, Homo sapiens
  misc_feature: GYAE6OF01CTBOF.42.14.B03.1.454.CMB.1.raw
  modified_base (203)..(205): a, c, t, g, unknown or other
  misc_feature (203)..(205): n is a, c, g, or t
tcagtgacgtatgtcacgaccggtgctcgatttagtgtgagtagtttgaaccctggtcaccgtctcctcagcatccaccaagggcccatcggtcttcccctggcgccctgctccaggagcacctctggggcacagcggcctgggctgcctggtcaaggactacttccacatacgtcactgagcgggctggcaaggcgcatagnnn

SEQ ID NO: 148527 - DNA, 204 bp, Homo sapiens
  misc_feature: GYAE6OF01E3M8I.42.14.B03.1.454.CMB.1.raw
  modified_base (204)..(204): a, c, t, g, unknown or other
  misc_feature (204)..(204): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagn

SEQ ID NO: 148528 - DNA, 207 bp, Homo sapiens
  misc_feature: GYAE6OF01CHBYC.42.14.B03.1.454.CMB.1.raw
  modified_base (205)..(207): a, c, t, g, unknown or other
  misc_feature (205)..(207): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnn

SEQ ID NO: 148529 - DNA, 204 bp, Homo sapiens; identical to SEQ ID NO: 148527
  misc_feature: GYAE6OF01CJXZI.42.14.B03.1.454.CMB.1.raw
  modified_base (204)..(204): a, c, t, g, unknown or other
  misc_feature (204)..(204): n is a, c, g, or t

SEQ ID NO: 148530 - DNA, 210 bp, Homo sapiens
  misc_feature: GYAE6OF01A93YV.42.14.B03.1.454.CMB.1.raw
  modified_base (205)..(210): a, c, t, g, unknown or other
  misc_feature (205)..(210): n is a, c, g, or t
tcagtgacgtatgtcacgaccggtgctcgatttagtgtgagtagtttgaacccgtggtcaccgtctcctcagcttccaccaagggcccatcggtcttcccctggccgccctgctccaggagcacctctggggcacagcggccctgggctgcctggtcaaggactacttccacatacgtcactgagcggctggcaaggcgcatagnnnnnn

SEQ ID NO: 148531 - DNA, 224 bp, Homo sapiens
  misc_feature: GYAE6OF01A1KY9.42.14.B03.1.454.CMB.1.raw
  modified_base (205)..(224): a, c, t, g, unknown or other
  misc_feature (205)..(224): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnnnnnnnnnnnnn

SEQ ID NO: 148532 - DNA, 208 bp, Homo sapiens
  misc_feature: GYAE6OF01AWMRW.42.14.B03.1.454.CMB.1.raw
  modified_base (205)..(208): a, c, t, g, unknown or other
  misc_feature (205)..(208): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnn

SEQ ID NO: 148533 - DNA, 311 bp, Homo sapiens
  misc_feature: GYAE6OF01BSU8A.42.14.B03.1.454.CMB.1.raw
  modified_base (265)..(311): a, c, t, g, unknown or other
  misc_feature (265)..(311): n is a, c, g, or t
tcagtgacgtatgtcacgaccggtgctcgatttagtgtgagtagtttaggggtttgggtaccggttgctaccggacgagtttcgactccgtggggccaggggaaccctcggtcaccgtctcctcagcttccaccaagggcccatcggtcttccccctggcgccctgctccaggagtcacctctgggggcacagcggccctgggcctgcctggtcaaggacgtacttccacactacgtcactgagcgggctggcaaggcgcatagnnnnnnnnnnnnnnnnnnnnnnnnnnnnnnnnnnnnnnnnnnnnnnn

SEQ ID NO: 148534 - DNA, 205 bp, Homo sapiens
  misc_feature: GYAE6OF01AXSWD.42.14.B03.1.454.CMB.1.raw
  modified_base (205)..(205): a, c, t, g, unknown or other
  misc_feature (205)..(205): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagn

SEQ ID NO: 148535 - DNA, 208 bp, Homo sapiens; identical to SEQ ID NO: 148532
  misc_feature: GYAE6OF01AP2C8.42.14.B03.1.454.CMB.1.raw
  modified_base (205)..(208): a, c, t, g, unknown or other
  misc_feature (205)..(208): n is a, c, g, or t

SEQ ID NO: 148536 - DNA, 214 bp, Homo sapiens
  misc_feature: GYAE6OF01A0L64.42.14.B03.1.454.CMB.1.raw
  modified_base (205)..(214): a, c, t, g, unknown or other
  misc_feature (205)..(214): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnnn

SEQ ID NO: 148537 - DNA, 205 bp, Homo sapiens; identical to SEQ ID NO: 148534
  misc_feature: GYAE6OF01A4AZX.42.14.B03.1.454.CMB.1.raw
  modified_base (205)..(205): a, c, t, g, unknown or other
  misc_feature (205)..(205): n is a, c, g, or t

SEQ ID NO: 148538 - DNA, 206 bp, Homo sapiens
  misc_feature: GYAE6OF01B571V.42.14.B03.1.454.CMB.1.raw
  modified_base (205)..(206): a, c, t, g, unknown or other
  misc_feature (205)..(206): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 148539 - DNA, 207 bp, Homo sapiens; identical to SEQ ID NO: 148528
  misc_feature: GYAE6OF01C3SMH.42.14.B03.1.454.CMB.1.raw
  modified_base (205)..(207): a, c, t, g, unknown or other
  misc_feature (205)..(207): n is a, c, g, or t

SEQ ID NO: 148540 - DNA, 210 bp, Homo sapiens
  misc_feature: GYAE6OF01DXAJU.42.14.B03.1.454.CMB.1.raw
  modified_base (206)..(210): a, c, t, g, unknown or other
  misc_feature (206)..(210): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctcgtgggggcacagcggccctgggctgcctggtcaaggactacttccacatacgtcactgagcgggctggcaaggcgcatagnnnnn

SEQ ID NO: 148541 - DNA, 210 bp, Homo sapiens
  misc_feature: GYAE6OF01CCP0M.42.14.B03.1.454.CMB.1.raw
  modified_base (205)..(210): a, c, t, g, unknown or other
  misc_feature (205)..(210): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnn

SEQ ID NO: 148542 - DNA, 249 bp, Homo sapiens
  misc_feature: GYAE6OF01CAVQP.42.14.B03.1.454.CMB.1.raw
  modified_base (210)..(249): a, c, t, g, unknown or other
  misc_feature (210)..(249): n is a, c, g, or t
tcagtgacgtatgtcacgaccggtgctcgatttagtgtgagtagtttgaacccgttgggtcaccgtctcctcagcttccaccaagggcccatcggtcttcccctggcgccctgctccaggagcgacctctgggggcacagcggccctgggctgcctggtcaaggactacttccacatacgtcactgagcgggcctggcaaggcgcatagnnnnnnnnnnnnnnnnnnnnnnnnnnnnnnnnnnnnnnnn

SEQ ID NO: 148543 - DNA, 121 bp, Homo sapiens
  misc_feature: GYAE6OF01EAV4C.42.14.B03.1.454.CMB.1.raw
  modified_base (114)..(121): a, c, t, g, unknown or other
  misc_feature (114)..(121): n is a, c, g, or t
tcagtgacgtatgtcacgaccggtgctcgatttagtgtgagtagttccgcgggcacgaccggtgctcgatttagtgtgagtagttcgaggcggcgtggacgaaggcgcaatagnnnnnnnn

SEQ ID NO: 148544 - DNA, 213 bp, Homo sapiens
  misc_feature: GYAE6OF01BDOHP.42.14.B03.1.454.CMB.1.raw
  modified_base (205)..(213): a, c, t, g, unknown or other
  misc_feature (205)..(213): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnn

SEQ ID NO: 148545 - DNA, 210 bp, Homo sapiens; identical to SEQ ID NO: 148540
  misc_feature: GYAE6OF01A160Q.42.14.B03.1.454.CMB.1.raw
  modified_base (206)..(210): a, c, t, g, unknown or other
  misc_feature (206)..(210): n is a, c, g, or t

SEQ ID NO: 148546 - DNA, 229 bp, Homo sapiens
  misc_feature: GYAE6OF01AO5MV.42.14.B03.1.454.CMB.1.raw
  modified_base (174)..(174): a, c, t, g, unknown or other
  misc_feature (174)..(174): n is a, c, g, or t
  modified_base (208)..(229): a, c, t, g, unknown or other
  misc_feature (208)..(229): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctcgtgggggcacacgcggccctgggctgcctggcaaggactacttccaanatacgtcactgagcgggctggcaaggcgcatagnnnnnnnnnnnnnnnnnnnnnn

SEQ ID NO: 148547 - DNA, 205 bp, Homo sapiens
  misc_feature: GYAE6OF02GXNPZ.42.14.B03.1.454.CMB.1.raw
  modified_base (204)..(205): a, c, t, g, unknown or other
  misc_feature (204)..(205): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnn

SEQ ID NO: 148548 - DNA, 206 bp, Homo sapiens
  misc_feature: GYAE6OF02FK8R2.42.14.B03.1.454.CMB.1.raw
  modified_base (204)..(206): a, c, t, g, unknown or other
  misc_feature (204)..(206): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnn

SEQ ID NO: 148549 - DNA, 205 bp, Homo sapiens
  misc_feature: GYAE6OF02FO8R9.42.14.B03.1.454.CMB.1.raw
  modified_base (204)..(205): a, c, t, g, unknown or other
  misc_feature (204)..(205): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttacacatacgtcactgagcgggctggcaaggcgcatagnn

SEQ ID NO: 148550 - DNA, 206 bp, Homo sapiens; identical to SEQ ID NO: 148548
  misc_feature: GYAE6OF02HPMYJ.42.14.B03.1.454.CMB.1.raw
  modified_base (204)..(206): a, c, t, g, unknown or other
  misc_feature (204)..(206): n is a, c, g, or t

SEQ ID NO: 148551 - DNA, 205 bp, Homo sapiens; identical to SEQ ID NO: 148547
  misc_feature: GYAE6OF02HUA43.42.14.B03.1.454.CMB.1.raw
  modified_base (204)..(205): a, c, t, g, unknown or other
  misc_feature (204)..(205): n is a, c, g, or t

SEQ ID NO: 148552 - DNA, 206 bp, Homo sapiens; identical to SEQ ID NO: 148538
  misc_feature: GYAE6OF02G00AB.42.14.B03.1.454.CMB.1.raw
  modified_base (205)..(206): a, c, t, g, unknown or other
  misc_feature (205)..(206): n is a, c, g, or t

SEQ ID NO: 148553 - DNA, 222 bp, Homo sapiens
  misc_feature: GYAE6OF02GR4N7.42.14.B03.1.454.CMB.1.raw
  modified_base (206)..(222): a, c, t, g, unknown or other
  misc_feature (206)..(222): n is a, c, g, or t
tcagtgacgtatgtcacgaccggtgctcgatttagtgtgagtagtttgaaccctggtcaccggtctccgtcagcttccaccaagggcccatcggtcttcccctggcgccctgctccaggagcacctctggggcacagcggccctgggctgcctggtcaaggactacttccacatacgtcactgagcgggctggcaaggcgcatagnnnnnnnnnnnnnnnnn

SEQ ID NO: 148554 - DNA, 205 bp, Homo sapiens; identical to SEQ ID NO: 148534
  misc_feature: GYAE6OF02F85QJ.42.14.B03.1.454.CMB.1.raw
  modified_base (205)..(205): a, c, t, g, unknown or other
  misc_feature (205)..(205): n is a, c, g, or t

SEQ ID NO: 148555 - DNA, 213 bp, Homo sapiens
  misc_feature: GYAE6OF02HFUY0.42.14.B03.1.454.CMB.1.raw
  modified_base (203)..(213): a, c, t, g, unknown or other
  misc_feature (203)..(213): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcggctggcaaggcgcatagnnnnnnnnnnn

SEQ ID NO: 148556 - DNA, 208 bp, Homo sapiens; identical to SEQ ID NO: 148532
  misc_feature: GYAE6OF02JCQSF.42.14.B03.1.454.CMB.1.raw
  modified_base (205)..(208): a, c, t, g, unknown or other
  misc_feature (205)..(208): n is a, c, g, or t

SEQ ID NO: 148557 - DNA, 117 bp, Homo sapiens
  misc_feature: GYAE6OF02H4P49.42.14.B03.1.454.CMB.1.raw
  modified_base (117)..(117): a, c, t, g, unknown or other
  misc_feature (117)..(117): n is a, c, g, or t
tcagtgacgtatgtcacgaccggtgctcgatttagtgtgagtagttccgcgggcacgaccggtgctcgatttagctgcgtcacgatctctcctgagcgggctggcaaggcgcatagn

SEQ ID NO: 148558 - DNA, 250 bp, Homo sapiens
  misc_feature: GYAE6OF02IY4UZ.42.14.B03.1.454.CMB.1.raw
  modified_base (211)..(250): a, c, t, g, unknown or other
  misc_feature (211)..(250): n is a, c, g, or t
tcagtgacgtatgtcacgaccggtgctcgatttagtgtgagtagtttgaaccctggtcaccgtctcctcagtcttccgaccaagggcccatcggtcttccccctggcgccctgctccaaggagccacctctgggggcacagcggccctgggctgcctggtcaaggactacgttccacatacgtcactgagcgggctggcaaggcgcatagnnnnnnnnnnnnnnnnnnnnnnnnnnnnnnnnnnnnnnnn

SEQ ID NO: 148559 - DNA, 206 bp, Homo sapiens; identical to SEQ ID NO: 148548
  misc_feature: GYAE6OF02F8WO2.42.14.B03.1.454.CMB.1.raw
  modified_base (204)..(206): a, c, t, g, unknown or other
  misc_feature (204)..(206): n is a, c, g, or t

SEQ ID NO: 148560 - DNA, 207 bp, Homo sapiens; identical to SEQ ID NO: 148528
  misc_feature: GYAE6OF02GCM2G.42.14.B03.1.454.CMB.1.raw
  modified_base (205)..(207): a, c, t, g, unknown or other
  misc_feature (205)..(207): n is a, c, g, or t

SEQ ID NO: 148561 - DNA, 208 bp, Homo sapiens
  misc_feature: GYAE6OF02IHBAQ.42.14.B03.1.454.CMB.1.raw
  modified_base (204)..(208): a, c, t, g, unknown or other
  misc_feature (204)..(208): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnnn

SEQ ID NO: 148562 - DNA, 208 bp, Homo sapiens; identical to SEQ ID NO: 148532
  misc_feature: GYAE6OF02F02YB.42.14.B03.1.454.CMB.1.raw
  modified_base (205)..(208): a, c, t, g, unknown or other
  misc_feature (205)..(208): n is a, c, g, or t

SEQ ID NO: 148563 - DNA, 204 bp, Homo sapiens; identical to SEQ ID NO: 148527
  misc_feature: GYAE6OF02HWBLW.42.14.B03.1.454.CMB.1.raw
  modified_base (204)..(204): a, c, t, g, unknown or other
  misc_feature (204)..(204): n is a, c, g, or t

SEQ ID NO: 148564 - DNA, 205 bp, Homo sapiens; identical to SEQ ID NO: 148547
  misc_feature: GYAE6OF02JC0LI.42.14.B03.1.454.CMB.1.raw
  modified_base (204)..(205): a, c, t, g, unknown or other
  misc_feature (204)..(205): n is a, c, g, or t

SEQ ID NO: 148565 - DNA, 208 bp, Homo sapiens
  misc_feature: GYAE6OF02F16Z8.42.14.B03.1.454.CMB.1.raw
  modified_base (206)..(208): a, c, t, g, unknown or other
  misc_feature (206)..(208): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctcgtgggggcacagcggccctgggctgcctggtcaaggactacttccacatacgtcactgagcgggctggcaaggcgcatagnnn

SEQ ID NO: 148566 - DNA, 214 bp, Homo sapiens
  misc_feature: GYAE6OF02I23PJ.42.14.B03.1.454.CMB.1.raw
  modified_base (205)..(214): a, c, t, g, unknown or other
  misc_feature (205)..(214): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctctgggggcacagcggccctgggctgcctggtcaaggactactccacatacgtcactgagcgggctggcaaggcgcatagnnnnnnnnnn

SEQ ID NO: 148567 - DNA, 217 bp, Homo sapiens
  misc_feature: GYAE6OF02GXH8C.42.14.B03.1.454.CMB.1.raw
  modified_base (206)..(217): a, c, t, g, unknown or other
  misc_feature (206)..(217): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctcgtgggggcacagcggccctgggctgcctggtcaaggactacttccacatacgtcactgagcgggctggcaaggcgcatagnnnnnnnnnnnn

SEQ ID NO: 148568 - DNA, 210 bp, Homo sapiens
  misc_feature: GYAE6OF02FG30Y.42.14.B03.1.454.CMB.1.raw
  modified_base (206)..(210): a, c, t, g, unknown or other
  misc_feature (206)..(210): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 148569 - DNA, 209 bp, Homo sapiens
  misc_feature: GYAE6OF02H8JSP.42.14.B03.1.454.CMB.1.raw
  modified_base (206)..(209): a, c, t, g, unknown or other
  misc_feature (206)..(209): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctctgggggcacagcggccctgggctgtctggtcaaggactacttccacatacgtcactgagcgggctggcaaggcgcatagnnnn

SEQ ID NO: 148570 - DNA, 207 bp, Homo sapiens; identical to SEQ ID NO: 148528
  misc_feature: GYAE6OF02IHS49.42.14.B03.1.454.CMB.1.raw
  modified_base (205)..(207): a, c, t, g, unknown or other
  misc_feature (205)..(207): n is a, c, g, or t

SEQ ID NO: 148571 - DNA, 210 bp, Homo sapiens
  misc_feature: GYAE6OF02I1QZU.42.14.B03.1.454.CMB.1.raw
  modified_base (204)..(210): a, c, t, g, unknown or other
  misc_feature (204)..(210): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctggggcacagcggccctgggctgcctggtcaaggactacttccacatacgtcactgagcgggctggcaaggcgcatagnnnnnnn

SEQ ID NO: 148572 - DNA, 212 bp, Homo sapiens
  misc_feature: GYAE6OF02HXF1S.42.14.B03.1.454.CMB.1.raw
  modified_base (205)..(212): a, c, t, g, unknown or other
  misc_feature (205)..(212): n is a, c, g, or t
tcagtgacgtatgtcacgaccggtgctcgatttagtgtgagtagtttgaaccctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnn

SEQ ID NO: 148573 - DNA, 209 bp, Homo sapiens
  misc_feature: GYAE6OF02HYSJD.42.14.B03.1.454.CMB.1.raw
  modified_base (206)..(209): a, c, t, g, unknown or other
  misc_feature (206)..(209): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnn

SEQ ID NO: 148574 - DNA, 224 bp, Homo sapiens
  misc_feature: GYAE6OF02GU7ZO.42.14.B03.1.454.CMB.1.raw
  modified_base (206)..(224): a, c, t, g, unknown or other
  misc_feature (206)..(224): n is a, c, g, or t
tcagtgacgtatgtcacgaccggtgctcgatttagtgtgagtagtttgaaccctgggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnnnnnnnnnnnn

SEQ ID NO: 148575 - DNA, 209 bp, Homo sapiens; identical to SEQ ID NO: 148573
  misc_feature: GYAE6OF02HRWSY.42.14.B03.1.454.CMB.1.raw
  modified_base (206)..(209): a, c, t, g, unknown or other
  misc_feature (206)..(209): n is a, c, g, or t

SEQ ID NO: 148576 - DNA, 224 bp, Homo sapiens
  misc_feature: GYAE6OF02G34G0.42.14.B03.1.454.CMB.1.raw
  modified_base (207)..(224): a, c, t, g, unknown or other
  misc_feature (207)..(224): n is a, c, g, or t
tcagtgacgtatgtcacgaccggtgctcgatttagtgtgagtagtttgaaccctggtcaccgtctcctcagcttccaccaagggcccagtcggtcttccccctggcgccctgctccaggagcacctctgggggcacagcggccctgggctgcctggtcaaggactacttccacatacgtcactgagcgggctggcaaggcgcatagnnnnnnnnnnnnnnnnnn

SEQ ID NO: 148577 - DNA, 215 bp, Homo sapiens
  misc_feature: GYAE6OF02GRCYC.42.14.B03.1.454.CMB.1.raw
  modified_base (206)..(215): a, c, t, g, unknown or other
  misc_feature (206)..(215): n is a, c, g, or t
tcagtgacgtatgtcacgaccggtgctcgatttagtgtgagtagtttgaaccctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnn

SEQ ID NO: 148578 - DNA, 216 bp, Homo sapiens
  misc_feature: GYAE6OF02JIR4C.42.14.B03.1.454.CMB.1.raw
  modified_base (195)..(195): a, c, t, g, unknown or other
  misc_feature (195)..(195): n is a, c, g, or t
  modified_base (212)..(213): a, c, t, g, unknown or other
  misc_feature (212)..(213): n is a, c, g, or t
  modified_base (215)..(216): a, c, t, g, unknown or other
  misc_feature (215)..(216): n is a, c, g, or t
tcagtgacgtatgtcacgaccggtgctcgatttagtgtgagtagtttgaaccctggtcaccgtctcctcagcttccaccaaggcccatcggtcttcccctggcgccctgcctccgaggagcacctcgtgggggcacgagcggccctgggcctgcctggtacgaaggactacttccacatacgtcactgagcgggntggcaaggcgtcatagnngnn

SEQ ID NO: 148579 - DNA, 247 bp, Homo sapiens
  misc_feature: GYAE6OF01CZZIS.52.65.F10.1.454.CMB.1.raw
  modified_base (246)..(247): a, c, t, g, unknown or other
  misc_feature (246)..(247): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccagggactaagctggacatcaaacgaactgtggctgcaccatctgtcttcatcttccgccatctgatatacgatcgctgagcgggctggcaaggcgcatagnn

SEQ ID NO: 148580 - DNA, 248 bp, Homo sapiens
  misc_feature: GYAE6OF01A66C3.52.65.F10.1.454.CMB.1.raw
  modified_base (247)..(248): a, c, t, g, unknown or other
  misc_feature (247)..(248): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagtttccgtacacctttggccaggggactaagctggacatcaaacgaactgtggctgcaccatctgtcttcatcttcccgccatctgatatacgatcgctgagcgggctggcaaggcgcatagnn

SEQ ID NO: 148581 - DNA, 249 bp, Homo sapiens
  misc_feature: GYAE6OF01ESOGJ.52.65.F10.1.454.CMB.1.raw
  modified_base (247)..(249): a, c, t, g, unknown or other
  misc_feature (247)..(249): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagtttccgtacacctttggccaggggactaagctggacatcaaacgaactgtggctgcaccatctgtcttcatcttcccgccatctgatatacgatcgctgagcgggctggcaaggcgcatagnnn

SEQ ID NO: 148582 - DNA, 251 bp, Homo sapiens
  misc_feature: GYAE6OF01C3J06.52.65.F10.1.454.CMB.1.raw
  modified_base (248)..(251): a, c, t, g, unknown or other
  misc_feature (248)..(251): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgcatctgatatacgatcgctgagcgggctggcaaggcgcatagnnnn

SEQ ID NO: 148583 - DNA, 251 bp, Homo sapiens
  misc_feature: GYAE6OF01B7VI0.52.65.F10.1.454.CMB.1.raw
  modified_base (248)..(251): a, c, t, g, unknown or other
  misc_feature (248)..(251): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgccatctgatatacgatcgctgagcgggctggcaaggcgcatagnnnn

SEQ ID NO: 148584 - DNA, 252 bp, Homo sapiens
  misc_feature: GYAE6OF01B3XX9.52.65.F10.1.454.CMB.1.raw
  modified_base (249)..(252): a, c, t, g, unknown or other
  misc_feature (249)..(252): n is a, c, g, or t
tcagcgcagtacgacacgaccggtgctcgatttagctacgctctaagggggacaaatttcactctcaccatcagcagcctgcagcctgaagattttgcgacttactattgtcaacgaggggtacagttttccgtacacctttggccaggggactaagctggacatcaaacgaactgtggctgcaccatctgtcttcatcttcccgccatctgatatacgatcgctgagcgggctggcaaggcgcatagnnnn

SEQ ID NO: 148585 - DNA, 249 bp, Homo sapiens
  misc_feature: GYAE6OF01A0BW6.52.65.F10.1.454.CMB.1.raw
  modified_base (247)..(249): a, c, t, g, unknown or other
  misc_feature (247)..(249): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgcatctgatatacgatcgctgagcgggctggcaaggcgcatagnnn

SEQ ID NO: 148586 - DNA, 248 bp, Homo sapiens
  misc_feature: GYAE6OF01C8NV9.52.65.F10.1.454.CMB.1.raw
  modified_base (246)..(248): a, c, t, g, unknown or other
  misc_feature (246)..(248): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccagggactaagctggacatcaaacgaactgtggctgcaccatctgtcttcatcttccgccatctgatatacgatcgctgagcgggctggcaaggcgcatagnnn

SEQ ID NO: 148587 - DNA, 249 bp, Homo sapiens
  misc_feature: GYAE6OF01ALRJP.52.65.F10.1.454.CMB.1.raw
  modified_base (247)..(249): a, c, t, g, unknown or other
  misc_feature (247)..(249): n is a, c, g, or t
tcagcgcagtacgacacgaccggtgctcgatttagctacgctctaagggggacaaatttcactctcaccatcagcagcctgcagcctgaagattttgcgacttactattgtcaacagggtacagttttccgtacacctttggccaggggactaagctggacatcaaacgaactgtggctgcaccatctgtcttcatcttcccgccatctgatatacgatcgctgagcgggctggcaaggcgcatagnnn

SEQ ID NO: 148588 - DNA, 251 bp, Homo sapiens
  misc_feature: GYAE6OF01DBG89.52.65.F10.1.454.CMB.1.raw
  modified_base (246)..(251): a, c, t, g, unknown or other
  misc_feature (246)..(251): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccagggactaagctggacatcaaacgaactgtggctgcaccatctgtcttcatcttcccgcatctgatatacgatcgctgagcgggctggcaaggcgcatagnnnnnn

SEQ ID NO: 148589 - DNA, 252 bp, Homo sapiens
  misc_feature: GYAE6OF01BS4DL.52.65.F10.1.454.CMB.1.raw
  modified_base (249)..(252): a, c, t, g, unknown or other
  misc_feature (249)..(252): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgccatctgatatacgatcgctgagcgggctggcaaggcgcatagnnnn

SEQ ID NO: 148590 - DNA, 264 bp, Homo sapiens
  misc_feature: GYAE6OF01CDUCK.52.65.F10.1.454.CMB.1.raw
  modified_base (261)..(264): a, c, t, g, unknown or other
  misc_feature (261)..(264): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacaccttcggtccgacgggacgtaagactggacgatcaaacgaaactagtggcgtgcaccatctgtcttcatcttcccgccatctgatatacgatcgctgaggcgggcgtggcgaaggcggcatagnnnn

SEQ ID NO: 148591 - DNA, 255 bp, Homo sapiens
  misc_feature: GYAE6OF01BIW38.52.65.F10.1.454.CMB.1.raw
  modified_base (249)..(255): a, c, t, g, unknown or other
  misc_feature (249)..(255): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgcatctgatatacgatcgctgagcgggctggcaaggcgcagtagnnnnnnn

SEQ ID NO: 148592 - DNA, 275 bp, Homo sapiens
  misc_feature: GYAE6OF01B6GV9.52.65.F10.1.454.CMB.1.raw
  modified_base (254)..(275): a, c, t, g, unknown or other
  misc_feature (254)..(275): n is a, c, g, or t
tcagcgcagtacgacacgaccggtgctcgatttagctacgctctaagggggacaaagttcactctcaccatcagcaggcctgcagccctgaagattttgcgtacttactattcgtcaacaggggtacagtttcccgtacacctttggcccaggggactaagctggacatcaaacgactgtggctgcacctatcctgtcttcatccttccccgccatctgatatacgatcgctgagcgggctggcaggcgcatgnnnnnnnnnnnnnnnnnnnnnn

SEQ ID NO: 148593 - DNA, 251 bp, Homo sapiens; identical to SEQ ID NO: 148583
  misc_feature: GYAE6OF01AYUEY.52.65.F10.1.454.CMB.1.raw
  modified_base (248)..(251): a, c, t, g, unknown or other
  misc_feature (248)..(251): n is a, c, g, or t

SEQ ID NO: 148594 - DNA, 250 bp, Homo sapiens
  misc_feature: GYAE6OF01BI2OR.52.65.F10.1.454.CMB.1.raw
  modified_base (237)..(237): a, c, t, g, unknown or other
  misc_feature (237)..(237): n is a, c, g, or t
  modified_base (243)..(248): a, c, t, g, unknown or other
  misc_feature (243)..(248): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccagggactaagctggacatcaaacgactgtgctgcaccatctgtcttcatcttccgcatctgatatacgatcgctgagcgggctggcaaggcncatagnnnnnnaa

SEQ ID NO: 148595 - DNA, 250 bp, Homo sapiens
  misc_feature: GYAE6OF01B2LI3.52.65.F10.1.454.CMB.1.raw
  modified_base (248)..(250): a, c, t, g, unknown or other
  misc_feature (248)..(250): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttccgccatctgatatacgatcgctgagcgggctggcaaggcgcatagnnn

SEQ ID NO: 148596 - DNA, 259 bp, Homo sapiens
  misc_feature: GYAE6OF01E28WD.52.65.F10.1.454.CMB.1.raw
  modified_base (213)..(213): a, c, t, g, unknown or other
  misc_feature (213)..(213): n is a, c, g, or t
  modified_base (247)..(259): a, c, t, g, unknown or other
  misc_feature (247)..(259): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatctcccgcatctgatntacgatcgctgagcgggctggcaaggcgcatagnnnnnnnnnnnnn

SEQ ID NO: 148597 - DNA, 250 bp, Homo sapiens
  misc_feature: GYAE6OF01B5LQI.52.65.F10.1.454.CMB.1.raw
  modified_base (245)..(250): a, c, t, g, unknown or other
  misc_feature (245)..(250): n is a, c, g, or t
tcagcgcagtacgacacgaccggtgctcgatttagctacgctctaagggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatctcccgcatctgatatacgatcgctgagcgggctggcaggcgcatagnnnnnn

SEQ ID NO: 148598 - DNA, 252 bp, Homo sapiens
  misc_feature: GYAE6OF01BX1KJ.52.65.F10.1.454.CMB.1.raw
  modified_base (136)..(136): a, c, t, g, unknown or other
  misc_feature (136)..(136): n is a, c, g, or t
  modified_base (249)..(252): a, c, t, g, unknown or other
  misc_feature (249)..(252): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtanacctttggccaggggactaagctggacatcaaacgactgtggctgcaccatctgtcttcatccttcccgccatctgatatacgatcgctgagcgggctggcaaggcgcatagnnnn

SEQ ID NO: 148599 - DNA, 264 bp, Homo sapiens
  misc_feature: GYAE6OF01E0UML.52.65.F10.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (247)..(248): a, c, t, g, unknown or other
  misc_feature (247)..(248): n is a, c, g, or t
  modified_base (250)..(264): a, c, t, g, unknown or other
  misc_feature (250)..(264): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtacacctttggccaggggactaagctggacatcaaacgactgtggctgcaccatctgtcttcatcttcccgcatctgatatacgatcgntgagcgggctggcaaggcncatagnntnnnnnnnnnnnnnnn

SEQ ID NO: 148600 - DNA, 249 bp, Homo sapiens
  misc_feature: GYAE6OF02HKNK0.52.65.F10.1.454.CMB.1.raw
  modified_base (247)..(249): a, c, t, g, unknown or other
  misc_feature (247)..(249): n is a, c, g, or t
tcagcgcagtacgacacgaccggtgctcgatttagctacgctctaaggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgccatctgatatacgatcgctgagcgggctggcaaggcgcatagnnn

SEQ ID NO: 148601 - DNA, 269 bp, Homo sapiens
  misc_feature: GYAE6OF02G8M4P.52.65.F10.1.454.CMB.1.raw
  modified_base (250)..(269): a, c, t, g, unknown or other
  misc_feature (250)..(269): n is a, c, g, or t
tcagcgcagtacgacacgaccggtgctcgatttagctacgctctaagggggacgaaatttcactctcaccatcagcagcctgcagcctgaagattttcgcgacttactattgtcgaacaggggtacagttttccgtacacctttggccaggggactaagctggacatcaaacgaactgtggctgcaccatctgtcttcatcttcccgcatctgatatacgatcgctgagcgggctggcaaggcgcatagnnnnnnnnnnnnnnnnnnnn

SEQ ID NO: 148602 - DNA, 248 bp, Homo sapiens
  misc_feature: GYAE6OF02GOUNO.52.65.F10.1.454.CMB.1.raw
  modified_base (245)..(248): a, c, t, g, unknown or other
  misc_feature (245)..(248): n is a, c, g, or t
tcagcgcagtacgacacgaccggtgctcgatttagctacgctctaagggggacaaatttcactctcaccatcagcagcctgcagcctgaagatttgcgacttactattgtcaacaggggtacagtttccgtacacctttggccaggggactaagctggacatcaaacgaactgtggctgcaccatctgtcttcatcttcccgcatctgatatacgatcgctgagcgggctggcaaggcgcatagnnnn

SEQ ID NO: 148603 - DNA, 251 bp, Homo sapiens; identical to SEQ ID NO: 148583
  misc_feature: GYAE6OF02G6EB8.52.65.F10.1.454.CMB.1.raw
  modified_base (248)..(251): a, c, t, g, unknown or other
  misc_feature (248)..(251): n is a, c, g, or t

SEQ ID NO: 148604 - DNA, 248 bp, Homo sapiens
  misc_feature: GYAE6OF02HCOFV.52.65.F10.1.454.CMB.1.raw
  modified_base (247)..(248): a, c, t, g, unknown or other
  misc_feature (247)..(248): n is a, c, g, or t
tcagcgcagtacgacacgaccggtgctcgatttagctacgctctaaggggacaaatttcactctcaccatcagcagcctgcagcctgaagattttgcgacttactattgtcaacaggggtacagttttccgtacacctttggccaggggactaagctggacatcaaacgaactgtggctgcaccatctgtcttcatcttcccgccatctgatatacgatcgctgagcgggctggcaaggcgcatagnn

SEQ ID NO: 148605 - DNA, 324 bp, Homo sapiens
  misc_feature: GYAE6OF02IYI74.52.65.F10.1.454.CMB.1.raw
  modified_base (253)..(253): a, c, t, g, unknown or other
  misc_feature (253)..(253): n is a, c, g, or t
  modified_base (259)..(261): a, c, t, g, unknown or other
  misc_feature (259)..(261): n is a, c, g, or t
  modified_base (263)..(264): a, c, t, g, unknown or other
  misc_feature (263)..(264): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (273)..(324): a, c, t, g, unknown or other
  misc_feature (273)..(324): n is a, c, g, or t
tcagcgcagtacgacacgaccggtgctcgatttagctacgctctaaggggggacgaaatttacactcctcaccgatcacgcagccctgcagccctgaaacgattttgcgacttactattgtcaacaggggttacagttttccgtacacctttggccaggggactaagctggacatcaaacgactgtggctgcaccatctgtcttcatcttccccgcatctgatatacgatcgctgagcgggctggccaaggcncatagnnngnnanncnangnnnnnnnnnnnnnnnnnnnnnnnnnnnnnnnnnnnnnnnnnnnnnnnnnnnn

SEQ ID NO: 148606 - DNA, 323 bp, Homo sapiens
  misc_feature: GYAE6OF02I1CO7.52.65.F10.1.454.CMB.1.raw
  modified_base (136)..(136): a, c, t, g, unknown or other
  misc_feature (136)..(136): n is a, c, g, or t
  modified_base (242)..(242): a, c, t, g, unknown or other
  misc_feature (242)..(242): n is a, c, g, or t
  modified_base (248)..(250): a, c, t, g, unknown or other
  misc_feature (248)..(250): n is a, c, g, or t
  modified_base (252)..(253): a, c, t, g, unknown or other
  misc_feature (252)..(253): n is a, c, g, or t
  modified_base (257)..(257): a, c, t, g, unknown or other
  misc_feature (257)..(257): n is a, c, g, or t
  modified_base (263)..(264): a, c, t, g, unknown or other
  misc_feature (263)..(264): n is a, c, g, or t
  modified_base (267)..(323): a, c, t, g, unknown or other
  misc_feature (267)..(323): n is a, c, g, or t
tcagcgcagtacgacacgaccggtgctcgatttagctacgctctaaggggggacaaatttcactctcaccatcagcagcctgcagcctgaagattttgcgacttactattgtcaacaggggtacagttttccgtanaccctttggccaggggactaagctggacatcaaacgactgtgctgcaccatctgtcttcatcttcccggccatctgatatacgatcgctgagcgggctggcaggcncatagnnngnnatcngcatcnnacnnnnnnnnnnnnnnnnnnnnnnnnnnnnnnnnnnnnnnnnnnnnnnnnnnnnnnnnn

SEQ ID NO: 148607 - DNA, 215 bp, Homo sapiens
  misc_feature: GYAE6OF01CPXWX.25.57.F02.1.454.CMB.1.raw
  modified_base (213)..(215): a, c, t, g, unknown or other
  misc_feature (213)..(215): n is a, c, g, or t
tcagactgtacagtcacgaccggtgctcgatttagctcgatatagttgggttgggaagaggaagactgacggtcctcccaggagttcaggtgctgggcaccttggcacgggaggtgtgtcacaagatttgggctctgggcacagcggccctgggctgcctggtcaaggactacttccactgtacagtctgagcgggctggcaaggcgcatagnnn

SEQ ID NO: 148608 - DNA, 219 bp, Homo sapiens
  misc_feature: GYAE6OF01BHD5O.25.57.F02.1.454.CMB.1.raw
  modified_base (216)..(219): a, c, t, g, unknown or other
  misc_feature (216)..(219): n is a, c, g, or t
tcagactgtacagtcacgaccggtgctcgatttagctcgatatagttgggtttggggaagaggaagactgacggtcctcccaggagttcaggtgctgggcaccttggcacggggaggtgtgtcacaagatttgggctctgggcacagcggccctgggctgcctggtcaaggactacttccactgtacagtctgagcgggctggcaaggcgcatagnnnn

SEQ ID NO: 148609 - DNA, 220 bp, Homo sapiens
  misc_feature: GYAE6OF01EMH8J.25.57.F02.1.454.CMB.1.raw
  modified_base (218)..(220): a, c, t, g, unknown or other
  misc_feature (218)..(220): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnn

SEQ ID NO: 148610 - DNA, 240 bp, Homo sapiens
  misc_feature: GYAE6OF01AIIJG.25.57.F02.1.454.CMB.1.raw
  modified_base (218)..(240): a, c, t, g, unknown or other
  misc_feature (218)..(240): n is a, c, g, or t
tcagactgtacagtcacgaccggtgctcgatttagctcgatatagttggggtttgggggaagaggaagactgacggtcctcccaggagttcaggtgctgggcaccttgggcacggggaggtgtgtcacaagatttgggctctgggcacagcggacctgggctgcctggtcaaggctacttccactgtacagtctgagcgggctggcaaggcgcatagnnnnnnnnnnnnnnnnnnnnnnn

SEQ ID NO: 148611 - DNA, 219 bp, Homo sapiens
  misc_feature: GYAE6OF01BI3WC.25.57.F02.1.454.CMB.1.raw
  modified_base (218)..(219): a, c, t, g, unknown or other
  misc_feature (218)..(219): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 148612 - DNA, 221 bp, Homo sapiens
  misc_feature: GYAE6OF01CS1GL.25.57.F02.1.454.CMB.1.raw
  modified_base (219)..(221): a, c, t, g, unknown or other
  misc_feature (219)..(221): n is a, c, g, or t
tcagactgtacagtcacgaccggtgctcgatttagctcgatatagttggggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnn

SEQ ID NO: 148613 - DNA, 366 bp, Homo sapiens
  misc_feature: GYAE6OF01C96NX.25.57.F02.1.454.CMB.1.raw
  modified_base (348)..(366): a, c, t, g, unknown or other
  misc_feature (348)..(366): n is a, c, g, or t
tcagactgtacagtcacgaccggtgctcgatttagctcgatatagttgggtttgggggaagaggaagactgacggtcctcccaggagttcaggtgcttgggcaccttgggcacgggggaggtgtgtcacaagatttgggcgtctgggcaccgtgggcactgggggacggtgtgtcacaagatttgggctctgggcaccctggtcacggtctcgtcagcttccaccaagggccatcggtcttcccctggcgcctgctccaggagcacctctggggcacagcggccctagggctgcctggtcaaggctacttccactgtacagtctgagcgggctggcaaggcgcatagnnnnnnnnnnnnnnnnnnn

SEQ ID NO: 148614 - DNA, 197 bp, Homo sapiens
  misc_feature: GYAE6OF01EJ4NM.25.57.F02.1.454.CMB.1.raw
  modified_base (195)..(197): a, c, t, g, unknown or other
  misc_feature (195)..(197): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgccccctcggtcactctgttcccgccctcctcactgtacagtctgagcgggctggcaaggcgcatagnnn

SEQ ID NO: 148615 - DNA, 221 bp, Homo sapiens
  misc_feature: GYAE6OF01A810V.25.57.F02.1.454.CMB.1.raw
  modified_base (216)..(221): a, c, t, g, unknown or other
  misc_feature (216)..(221): n is a, c, g, or t
tcagactgtacagtcacgaccggtgctcgatttagctcgatatagttgggtttggggaagaggaagactgacggtcctcccaggagttcaggtgctgggcaccttggcacggggaggtgtgtcacaagatttgggctctgggcacagcggccctgggctgcctggtcaaggactacttccactgtacagtctgagcgggctggcaaggcgcatagnnnnnn

SEQ ID NO: 148616 - DNA, 262 bp, Homo sapiens
  misc_feature: GYAE6OF01BQYBT.25.57.F02.1.454.CMB.1.raw
  modified_base (235)..(262): a, c, t, g, unknown or other
  misc_feature (235)..(262): n is a, c, g, or t
tcagactgtacagtcacgaccggtgctcgatttagctcgatataggttgggtttgggactactggggccagggtaccctggccatcgtctcctcagcctccgacccaagggcccatcggtcttcccccgtggccgccctgctccaggagcacctccgagagcacagcggccctgggctgcctggtcaaggactacttccactgtacagtctgagcgggctggcaaggcgcatagnnnnnnnnnnnnnnnnnnnnnnnnnnnn

SEQ ID NO: 148617 - DNA, 257 bp, Homo sapiens
  misc_feature: GYAE6OF01AXER6.25.57.F02.1.454.CMB.1.raw
  modified_base (221)..(221): a, c, t, g, unknown or other
  misc_feature (221)..(221): n is a, c, g, or t
  modified_base (227)..(257): a, c, t, g, unknown or other
  misc_feature (227)..(257): n is a, c, g, or t
tcagactgtacagtcacgaccggtgctcgatttagctcgatatagttgggtttggggactactgggccagggtaccctggccatcgtctcctcagcctccaccaaggcccatcggtcttcccctggcgccctgctccaggagcacctccgagagcacagcggccctgggctgcctggtcaaggactacttccactgtacagtctgagcggctggcaaggcncatagnnnnnnnnnnnnnnnnnnnnnnnnnnnnnnn

SEQ ID NO: 148618 - DNA, 220 bp, Homo sapiens
  misc_feature: GYAE6OF01B7CDZ.25.57.F02.1.454.CMB.1.raw
  modified_base (219)..(220): a, c, t, g, unknown or other
  misc_feature (219)..(220): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnn

SEQ ID NO: 148619 - DNA, 233 bp, Homo sapiens
  misc_feature: GYAE6OF01CL6T0.25.57.F02.1.454.CMB.1.raw
  modified_base (230)..(233): a, c, t, g, unknown or other
  misc_feature (230)..(233): n is a, c, g, or t
tcagactgtacagtcacgaccggtgctcgatttagctcgatatagttgggtttggggactactggggccagggtaccctggccatcgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnn

SEQ ID NO: 148620 - DNA, 222 bp, Homo sapiens
  misc_feature: GYAE6OF01ASCH3.25.57.F02.1.454.CMB.1.raw
  modified_base (220)..(222): a, c, t, g, unknown or other
  misc_feature (220)..(222): n is a, c, g, or t
tcagactgtacagtcacgaccggtgctcgatttagctcgatatagttggggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnn

SEQ ID NO: 148621 - DNA, 259 bp, Homo sapiens
  misc_feature: GYAE6OF01EHGWK.25.57.F02.1.454.CMB.1.raw
  modified_base (223)..(224): a, c, t, g, unknown or other
  misc_feature (223)..(224): n is a, c, g, or t
  modified_base (226)..(259): a, c, t, g, unknown or other
  misc_feature (226)..(259): n is a, c, g, or t
tcagactgtacagtcacgaccggtgctcgatttagctcgatatagttgggtttgggggaagaggaaggactgacggtcctcccaggagttcacggtgcctgggcaccttgggctacgggggaggttgtgtcacaagatttgggctctgggcacagcggccctgggctgcctggtcaaggctacttccatgtacagtctgagcgggctggcaaggcgcagtagnngnnnnnnnnnnnnnnnnnnnnnnnnnnnnnnnnnn

SEQ ID NO: 148622 - DNA, 194 bp, Homo sapiens
  misc_feature: GYAE6OF01CY0BO.25.57.F02.1.454.CMB.1.raw
  modified_base (193)..(194): a, c, t, g, unknown or other
  misc_feature (193)..(194): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgcccctcggtcactctgttcccgccctcctcactgtacagctgagcgggctggcaaggcgcatagnn

SEQ ID NO: 148623 - DNA, 196 bp, Homo sapiens
  misc_feature: GYAE6OF01BCTE9.25.57.F02.1.454.CMB.1.raw
  modified_base (195)..(196): a, c, t, g, unknown or other
  misc_feature (195)..(196): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgccccctcggtcactctgttcccgccctcctcactgtacagtctgagcgggctggcaaggcgcatagnn

SEQ ID NO: 148624 - DNA, 352 bp, Homo sapiens
  misc_feature: GYAE6OF01CM10O.25.57.F02.1.454.CMB.1.raw
  modified_base (347)..(352): a, c, t, g, unknown or other
  misc_feature (347)..(352): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcaccctggtcacggtctcgtcagcttccaccaagggcccatcggtcttccccctggcgccctgctcccaggagcacctctgggggcacagcggccctgggctgcctggtcaaggactacttccactgtacagtctgagcggctggcaaggcgcatagnnnnnn

SEQ ID NO: 148625 - DNA, 222 bp, Homo sapiens
  misc_feature: GYAE6OF01CA844.25.57.F02.1.454.CMB.1.raw
  modified_base (219)..(222): a, c, t, g, unknown or other
  misc_feature (219)..(222): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnn

SEQ ID NO: 148626 - DNA, 221 bp, Homo sapiens
  misc_feature: GYAE6OF01CQPHJ.25.57.F02.1.454.CMB.1.raw
  modified_base (219)..(221): a, c, t, g, unknown or other
  misc_feature (219)..(221): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnn

SEQ ID NO: 148627 - DNA, 234 bp, Homo sapiens
  misc_feature: GYAE6OF01DVCNE.25.57.F02.1.454.CMB.1.raw
  modified_base (224)..(224): a, c, t, g, unknown or other
  misc_feature (224)..(224): n is a, c, g, or t
  modified_base (230)..(234): a, c, t, g, unknown or other
  misc_feature (230)..(234): n is a, c, g, or t
tcagactgtacagtcacgaccggtgctcgatttagctcgatatagttgggtttggggactactggggccagggtaccctggccatcgtctcctcagcctccaccaagggcccatcggtcttcccctggcgccctgctccaggagcacctccgagagcacagcggccctgggctgcctggtcaaggactacttccactgtacagtctgagcgggctggcaaggcncatagnnnnn

SEQ ID NO: 148628 - DNA, 226 bp, Homo sapiens
  misc_feature: GYAE6OF01C3P96.25.57.F02.1.454.CMB.1.raw
  modified_base (221)..(226): a, c, t, g, unknown or other
  misc_feature (221)..(226): n is a, c, g, or t
tcagactgtacagtcacgaccggtgctcgatttagctcgatatagttggggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnnn

SEQ ID NO: 148629 - DNA, 230 bp, Homo sapiens
  misc_feature: GYAE6OF01EKXMG.25.57.F02.1.454.CMB.1.raw
  modified_base (230)..(230): a, c, t, g, unknown or other
  misc_feature (230)..(230): n is a, c, g, or t
tcagactgtacagtcacgaccggtgctcgatttagctcgatatagttgggtttggggactactggggccagggtaccctggccatcgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagn

SEQ ID NO: 148630 - DNA, 226 bp, Homo sapiens
  misc_feature: GYAE6OF01AH8BX.25.57.F02.1.454.CMB.1.raw
  modified_base (218)..(226): a, c, t, g, unknown or other
  misc_feature (218)..(226): n is a, c, g, or t
tcagactgtacagtcacgaccggtgctcgatttagctcgatatagttgggtttgggggaagaggaagactgacgatacctcccaggagttcaggtgctgggcaccttgggcacgggggagtgtgtcacaagatttgggctctgggcacagcggccctgggctgcctggtcaaggactacttccatgtacagtctgagcgggctggcaaggcgcatagnnnnnnnnn

SEQ ID NO: 148631 - DNA, 197 bp, Homo sapiens
  misc_feature: GYAE6OF01ATG9C.25.57.F02.1.454.CMB.1.raw
  modified_base (195)..(197): a, c, t, g, unknown or other
  misc_feature (195)..(197): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgccccctcggtcactctgttcccaccctcctcactgtacagtctgagcgggctggcaaggcgcatagnnn

SEQ ID NO: 148632 - DNA, 234 bp, Homo sapiens
  misc_feature: GYAE6OF01EAC29.25.57.F02.1.454.CMB.1.raw
  modified_base (133)..(133): a, c, t, g, unknown or other
  misc_feature (133)..(133): n is a, c, g, or t
  modified_base (220)..(234): a, c, t, g, unknown or other
  misc_feature (220)..(234): n is a, c, g, or t
tcagactgtacagtcacgaccggtgctcgatttagctcgatatagttggggtttggggaagaggaagactgacggtcctcccaggagttcaggtgctgggcaccttgggcacggggaggtgtgtcacaaaagntttgggctctgggcacagcggccctgggctgcctggtcaaggactacttccactgtacagtctgagcgggctggcaaggcgcatagnnnnnnnnnnnnnnn

SEQ ID NO: 148633 - DNA, 314 bp, Homo sapiens
  misc_feature: GYAE6OF01EKW2U.25.57.F02.1.454.CMB.1.raw
  modified_base (234)..(234): a, c, t, g, unknown or other
  misc_feature (234)..(234): n is a, c, g, or t
  modified_base (238)..(314): a, c, t, g, unknown or other
  misc_feature (238)..(314): n is a, c, g, or t
tcagactgtacagtcacgaccggtgctcgatttagctcgatatagttgggggtttgggggggaagaggaagactgaccggtcctcccaggagttccaggtgctgggcaccttgggcacgggggaggtgtgtcacgaagattttgggcttcgtggggcacagcggccctgggctgccctggtcaaggctacttccatgtacagtctggagcgggctgggacaagggcgcgatagnagtnnnnnnnnnnnnnnnnnnnnnnnnnnnnnnnnnnnnnnnnnnnnnnnnnnnnnnnnnnnnnnnnnnnnnnnnnnnnn

SEQ ID NO: 148634 - DNA, 302 bp, Homo sapiens
  misc_feature: GYAE6OF01DMS4J.25.57.F02.1.454.CMB.1.raw
  modified_base (288)..(302): a, c, t, g, unknown or other
  misc_feature (288)..(302): n is a, c, g, or t
tcagactgtacagtcacgaccggtgctcgatttagctcgatatagttgggtttggggggaagaggaagactgacggtcctcccaggagttcaggtgctgggcaccttgggcacggggggaggtgtgtcaacaagtagtttgggctcgtgggccaccggtgggcagtgggggagtgtgtcaacaagtagtttgggctcgtgggcacgaggccggcccgtggggctgccgtggtacaaggtactaccttccactgtacagtctgagcgggctggacaaggcgacagtagnnnnnnnnnnnnnnn

SEQ ID NO: 148635 - DNA, 268 bp, Homo sapiens
  misc_feature: GYAE6OF01DXUF3.25.57.F02.1.454.CMB.1.raw
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (261)..(268): a, c, t, g, unknown or other
  misc_feature (261)..(268): n is a, c, g, or t
tcagactgtacagtcacgaccggtgctcgatttagctcgatatagttgggtttggggggaagaggaagactgacggtcctcccaggagttcaggtgctgggcaccttgggcgacgggggaggtgtgtcacaagatttgggctctgggcaccgtgggcagtgggggagtgtgtcacaagatttgggctctgggcacagcggccctggctgcctggtcaaggctacttcactgtacagtctgagcggctggcaggcncanagnnnnnnnn

SEQ ID NO: 148636 - DNA, 226 bp, Homo sapiens
  misc_feature: GYAE6OF01A1TIO.25.57.F02.1.454.CMB.1.raw
  modified_base (218)..(226): a, c, t, g, unknown or other
  misc_feature (218)..(226): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggctacttccactgtacagtctgagcgggctggcaaggcgcatagnnnnnnnnn

SEQ ID NO: 148637 - DNA, 223 bp, Homo sapiens
  misc_feature: GYAE6OF01BPCUB.25.57.F02.1.454.CMB.1.raw
  modified_base (219)..(223): a, c, t, g, unknown or other
  misc_feature (219)..(223): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnn

SEQ ID NO: 148638 - DNA, 408 bp, Homo sapiens
  misc_feature: GYAE6OF01EZQM7.25.57.F02.1.454.CMB.1.raw
  modified_base (391)..(408): a, c, t, g, unknown or other
  misc_feature (391)..(408): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctggggcaccgtgggcagtgggggaggtgtgtcacaagatttggggctcgtgggcaccctggtcacggtctcgtcagtcttccaccaagggcccatccggtccttccccctggccgccctgcctccgaggacgccaccgtcgtgggggccacgacggccggcccgtgggcctcgccctggtaccaagggtacctaccttccacgttgtacctagtctggacggccgggcctggacgaaggcgacagtagnnnnnnnnnnnnnnnnnn

SEQ ID NO: 148639 - DNA, 258 bp, Homo sapiens
  misc_feature: GYAE6OF01D6FPX.25.57.F02.1.454.CMB.1.raw
  modified_base (224)..(224): a, c, t, g, unknown or other
  misc_feature (224)..(224): n is a, c, g, or t
  modified_base (230)..(258): a, c, t, g, unknown or other
  misc_feature (230)..(258): n is a, c, g, or t
tcagactgtacagtcacgaccggtgctcgatttagctcgatatagttggggttggggggggaagtaggaagacgtgaacggtcctcccaggagttcaggtcgactgggcacccttgggcacgggggagtgtcgtccacaagtatttgggctcgtgggcacgaggcggccctgggctgcctggtcaaggctactcactgtacagtctgagcgggctggcaaggcncatagnnnnnnnnnnnnnnnnnnnnnnnnnnnnn

SEQ ID NO: 148640 - DNA, 223 bp, Homo sapiens
  misc_feature: GYAE6OF01AYAJP.25.57.F02.1.454.CMB.1.raw
  modified_base (220)..(223): a, c, t, g, unknown or other
  misc_feature (220)..(223): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnn

SEQ ID NO: 148641 - DNA, 290 bp, Homo sapiens
  misc_feature: GYAE6OF01CR2EU.25.57.F02.1.454.CMB.1.raw
  modified_base (240)..(240): a, c, t, g, unknown or other
  misc_feature (240)..(240): n is a, c, g, or t
  modified_base (271)..(290): a, c, t, g, unknown or other
  misc_feature (271)..(290): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcagtgggggagtgtgtcacaagagtttgggctctgggcacgagccggccctggggctgcctggtcaaggactacttccatgtacngtctggagcgggctggcaaggcgctagtagnnnnnnnnnnnnnnnnnnnn

SEQ ID NO: 148642 - DNA, 713 bp, Homo sapiens
  misc_feature: GYAE6OF01CVT30.25.57.F02.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
tcagactgtacagtcacgaccggtgctcgatttagctcgatatagttgggtttggggggaagaggaagactgacggtcctcccaggagttcaggtgcgtgggcaccttgggcacgggggaggtgtgtcacaagatttgggctcgtgggcaccgtggagtcgtgggggagcgtggtccagcctgggaatcctgagactctcgtgtgtggcgcctagactcaccttnagtagttanggcttcgtctgggtccgcagtcgtccaggcaaggggctggagtggctggggatttacgtggtctgacagacaatgacatagtcacggcgagtccgtggacgggccatttccacctgtcctaccggaagggtacctaaactttcccgaaaaaggtaccgtaaaccccttcgtaacttccgtacgaactaaaagtcgaaaacctaacgtttggaaagtacggtacgaaggtacgtaccggtacgtttaataccgtaggtcgacgtaccgtagaggtacgtaggacgtaaggtaaaacgtcgttacgtaccgtaccgtaccgttaccccggtacgtaccgtcggtacgggaccgacgggtaccctaacccggtcggtacccgtacccgttaccgtcccgtacgtaccggttccctacccgtaaccggtaacccggtacccgtacgttcccgggtttaccccttccccccggtggtcccccgg

SEQ ID NO: 148643 - DNA, 231 bp, Homo sapiens
  misc_feature: GYAE6OF01BXVUJ.25.57.F02.1.454.CMB.1.raw
  modified_base (216)..(216): a, c, t, g, unknown or other
  misc_feature (216)..(216): n is a, c, g, or t
  modified_base (222)..(231): a, c, t, g, unknown or other
  misc_feature (222)..(231): n is a, c, g, or t
tcagactgtacagtcacgaccggtgctcgatttagctcgatatagttggggtttggggggaagaggaagactgacggtcctcccaggagttcaggtgctgggcaccttgggcacgggggaggtgtgtcacaagatttgggctctgggcacagcggccctgggctgcctggtcaaggactaccttccactgtacagtctgagcgggctggcaaggcncatagnnnnnnnnnn

SEQ ID NO: 148644 - DNA, 416 bp, Homo sapiens
  misc_feature: GYAE6OF01BHF1Q.25.57.F02.1.454.CMB.1.raw
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (375)..(376): a, c, t, g, unknown or other
  misc_feature (375)..(376): n is a, c, g, or t
  modified_base (378)..(416): a, c, t, g, unknown or other
  misc_feature (378)..(416): n is a, c, g, or t
tcagactgtacagtcacgaccggtgctcgatttagctcgatatagtttggggtttgggggggaagaggaagactgacggtcctcccaggagttcaggtgctgggcaccttgggcgacgggggaggtgtgtcacaagatttgggctctgggcaccgtgggcagtgggggagtgtgtcacaagtatttggctctgggccaccctggtccacggtctcgtcagtccttccacgaaggcccatcggtccttcccctggccgccctgctccaggagccaccgtcgtggggcacgaggccggcctgggctgcctggtaccgaaggtcctacgttccaactgtaaccagttccaggngcggctggacaaggcgacaagtngnngnnnnnnnnnnnnnnnnnnnnnnnnnnnnnnnnnnnnnnn

SEQ ID NO: 148645 - DNA, 257 bp, Homo sapiens
  misc_feature: GYAE6OF01ATQRN.25.57.F02.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (223)..(257): a, c, t, g, unknown or other
  misc_feature (223)..(257): n is a, c, g, or t
tcagactgtacagtcacgaccggtgctcgatttagctcgatatagttggggtttggggggggaagaggaagactggacggtcctcccaggagttcaggtgctcgggcaccttgggcacgggggaggtgtgtcacaagatttgggctctgggcacagcggcctgggctgcctggtcaaggactattccactgtacagtctgagcgggntggcaaggcgcanagnnnnnnnnnnnnnnnnnnnnnnnnnnnnnnnnnnn

SEQ ID NO: 148646 - DNA, 424 bp, Homo sapiens
  misc_feature: GYAE6OF01B57UH.25.57.F02.1.454.CMB.1.raw
  modified_base (356)..(356): a, c, t, g, unknown or other
  misc_feature (356)..(356): n is a, c, g, or t
  modified_base (398)..(399): a, c, t, g, unknown or other
  misc_feature (398)..(399): n is a, c, g, or t
  modified_base (403)..(424): a, c, t, g, unknown or other
  misc_feature (403)..(424): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagattgggctctgggcaccgtgggcagtgggggaggtgtgtcacaagatttgggctctgggccaccctggtcacggtctcgtcagtccttccaccgaacgggccctagtccggttcccttccccccgtggccgcccctgcctccgaggacgcaccgtcgtcggggccacgacggccggccgtcgggctcgtccgtcggtacgaacggtactacttcctactgtacncgttactggacggcgggcgtcggacgagggcgacacgtaggnncgtnnnnnnnnnnnnnnnnnnnnnn

SEQ ID NO: 148647 - DNA, 255 bp, Homo sapiens
  misc_feature: GYAE6OF01EKN5W.25.57.F02.1.454.CMB.1.raw
  modified_base (119)..(119): a, c, t, g, unknown or other
  misc_feature (119)..(119): n is a, c, g, or t
  modified_base (133)..(133): a, c, t, g, unknown or other
  misc_feature (133)..(133): n is a, c, g, or t
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (222)..(255): a, c, t, g, unknown or other
  misc_feature (222)..(255): n is a, c, g, or t
tcagactgtacagtcacgaccggtgctcgatttagctcgatatagttgggttggggggaagaggaagactgacggtcctcccaggagttcaggtgcgtgggcaccttgggcacgggggnggtgtgtcacaagntttgggctcgtgggcctacaggcggccctggggctggcctggtcaaggctactcactgtacngtctgagcggntggcaggcncgatagnnnnnnnnnnnnnnnnnnnnnnnnnnnnnnnnnn

SEQ ID NO: 148648 - DNA, 218 bp, Homo sapiens
  misc_feature: GYAE6OF02HAI7F.25.57.F02.1.454.CMB.1.raw
  modified_base (217)..(218): a, c, t, g, unknown or other
  misc_feature (217)..(218): n is a, c, g, or t
tcagactgtacagtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnn

SEQ ID NO: 148649 - DNA, 217 bp, Homo sapiens
  misc_feature: GYAE6OF02GVVZE.25.57.F02.1.454.CMB.1.raw
  modified_base (216)..(217): a, c, t, g, unknown or other
  misc_feature (216)..(217): n is a, c, g, or t
tcagactgtacagtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactattccactgtacagtctgagcgggctggcaaggcgcatagnn

SEQ ID NO: 148650 - DNA, 218 bp, Homo sapiens; identical to SEQ ID NO: 148648
  misc_feature: GYAE6OF02H3ZGC.25.57.F02.1.454.CMB.1.raw
  modified_base (217)..(218): a, c, t, g, unknown or other
  misc_feature (217)..(218): n is a, c, g, or t

SEQ ID NO: 148651 - DNA, 219 bp, Homo sapiens
  misc_feature: GYAE6OF02IU2OB.25.57.F02.1.454.CMB.1.raw
  modified_base (219)..(219): a, c, t, g, unknown or other
  misc_feature (219)..(219): n is a, c, g, or t
tcagactgtacagtcacgaccggtgctcgatttagctcgatatagttggggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagn

SEQ ID NO: 148652 - DNA, 228 bp, Homo sapiens
  misc_feature: GYAE6OF02IF6AF.25.57.F02.1.454.CMB.1.raw
  modified_base (216)..(228): a, c, t, g, unknown or other
  misc_feature (216)..(228): n is a, c, g, or t
tcagactgtacagtcacgaccggtgctcgatttagctcgatatagttgggtttggggaagaggaagactgacggtcctcccaggagttcaggtgcctgggcaccttgggcacggggaggtgtgtcacaagatttgggctctgggcacagcggccctgggctgcctggtcaaggctacttccactgtacagtctgagcggctggcaaggcgcatagnnnnnnnnnnnnn

SEQ ID NO: 148653 - DNA, 227 bp, Homo sapiens
  misc_feature: GYAE6OF02HQFOY.25.57.F02.1.454.CMB.1.raw
  modified_base (197)..(198): a, c, t, g, unknown or other
  misc_feature (197)..(198): n is a, c, g, or t
  modified_base (200)..(204): a, c, t, g, unknown or other
  misc_feature (200)..(204): n is a, c, g, or t
  modified_base (206)..(227): a, c, t, g, unknown or other
  misc_feature (206)..(227): n is a, c, g, or t
tcagactgtacagtcacgaccggtgctcgatttagctcgatataggttgggtttgggatcgccagtctgagtggtccgtacggtgttcggcggagggaccaagctgaccgtcctaggtcagcccaaggctgccccctggtcactctgttcccgcctcctcactgtacagtctgagcgggctggacaaggcgcatagnngnnnnngnnnnnnnnnnnnnnnnnnnnnn

SEQ ID NO: 148654 - DNA, 219 bp, Homo sapiens
  misc_feature: GYAE6OF02IIM5D.25.57.F02.1.454.CMB.1.raw
  modified_base (217)..(219): a, c, t, g, unknown or other
  misc_feature (217)..(219): n is a, c, g, or t
tcagactgtacagtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcgggctggcaaggcgcatagnnn

SEQ ID NO: 148655 - DNA, 219 bp, Homo sapiens; identical to SEQ ID NO: 148611
  misc_feature: GYAE6OF02HZ63T.25.57.F02.1.454.CMB.1.raw
  modified_base (218)..(219): a, c, t, g, unknown or other
  misc_feature (218)..(219): n is a, c, g, or t

SEQ ID NO: 148656 - DNA, 230 bp, Homo sapiens
  misc_feature: GYAE6OF02F2UC4.25.57.F02.1.454.CMB.1.raw
  modified_base (202)..(206): a, c, t, g, unknown or other
  misc_feature (202)..(206): n is a, c, g, or t
  modified_base (208)..(209): a, c, t, g, unknown or other
  misc_feature (208)..(209): n is a, c, g, or t
  modified_base (211)..(230): a, c, t, g, unknown or other
  misc_feature (211)..(230): n is a, c, g, or t
tcagactgtacagtcacgaccggtgctcgatttagctcgatatagttgggtttgggatgccagtctgagtggtccgacggtgttcggcggtagggaccgaagctgaccgtcctaggtccagccctaaggctgccccctggtcactctggttcccgccgtcctcacctggtacagtctgagcggctggctaaggcgcagtagnnnnntnnannnnnnnnnnnnnnnnnnnn

SEQ ID NO: 148657 - DNA, 222 bp, Homo sapiens
  misc_feature: GYAE6OF02JGPAC.25.57.F02.1.454.CMB.1.raw
  modified_base (133)..(133): a, c, t, g, unknown or other
  misc_feature (133)..(133): n is a, c, g, or t
  modified_base (218)..(222): a, c, t, g, unknown or other
  misc_feature (218)..(222): n is a, c, g, or t
tcagactgtacagtcacgaccggtgctcgatttagctcgatatagttgggtttgggggaaggaggaagactgacggtcctcccaggagttcaggtgctgggccaccttgggcacggggaggtgtgtccacagntttgggctctgggcacagcggccctgggctgcctggtcaaggctacttccactgtacagtctgagcgggctggcaaggcgcatgnnnnn

SEQ ID NO: 148658 - DNA, 351 bp, Homo sapiens
  misc_feature: GYAE6OF02HGLT6.25.57.F02.1.454.CMB.1.raw
  modified_base (346)..(351): a, c, t, g, unknown or other
  misc_feature (346)..(351): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcaccctggtcacggtctcgtcagcttccaccaagggcccatcggtcttccccctggcgccctgctccaggagcacctctgggggcacagcggccctgggctgcctggtcaaggactacttccactgtacagtctgagcgggctggcaaggcgcatagnnnnnn

SEQ ID NO: 148659 - DNA, 196 bp, Homo sapiens; identical to SEQ ID NO: 148623
  misc_feature: GYAE6OF02GXOJW.25.57.F02.1.454.CMB.1.raw
  modified_base (195)..(196): a, c, t, g, unknown or other
  misc_feature (195)..(196): n is a, c, g, or t

SEQ ID NO: 148660 - DNA, 221 bp, Homo sapiens; identical to SEQ ID NO: 148626
  misc_feature: GYAE6OF02GE0F3.25.57.F02.1.454.CMB.1.raw
  modified_base (219)..(221): a, c, t, g, unknown or other
  misc_feature (219)..(221): n is a, c, g, or t

SEQ ID NO: 148661 - DNA, 195 bp, Homo sapiens
  misc_feature: GYAE6OF02GXDZ1.25.57.F02.1.454.CMB.1.raw
  modified_base (195)..(195): a, c, t, g, unknown or other
  misc_feature (195)..(195): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgccccctcggtcactctgttcccaccctcctcactgtacagtctgagcgggctggcaaggcgcatagn

SEQ ID NO: 148662 - DNA, 220 bp, Homo sapiens
  misc_feature: GYAE6OF02IBC0I.25.57.F02.1.454.CMB.1.raw
  modified_base (217)..(220): a, c, t, g, unknown or other
  misc_feature (217)..(220): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccactgtacagtctgagcggctggcaaggcgcatagnnnn

SEQ ID NO: 148663 - DNA, 220 bp, Homo sapiens; identical to SEQ ID NO: 148609
  misc_feature: GYAE6OF02HHYN3.25.57.F02.1.454.CMB.1.raw
  modified_base (218)..(220): a, c, t, g, unknown or other
  misc_feature (218)..(220): n is a, c, g, or t

SEQ ID NO: 148664 - DNA, 219 bp, Homo sapiens; identical to SEQ ID NO: 148611
  misc_feature: GYAE6OF02GISUK.25.57.F02.1.454.CMB.1.raw
  modified_base (218)..(219): a, c, t, g, unknown or other
  misc_feature (218)..(219): n is a, c, g, or t

SEQ ID NO: 148665 - DNA, 354 bp, Homo sapiens
  misc_feature: GYAE6OF02GV78K.25.57.F02.1.454.CMB.1.raw
  modified_base (350)..(354): a, c, t, g, unknown or other
  misc_feature (350)..(354): n is a, c, g, or t
tcagactgtacagtcacgaccggtgctcgatttagctcgatatagttgggtttgggggaagaggaagactgacggtcctcccaggagttcaggtgtcgttgggcaccttgggcgacgggggaggtgtgtcacaagatttgggctctgggcaccgtgggcatgggggaggtgtgtcacaagattttggctctgggcaccctggtcacggtctcgtcagcttccaccaagggcccatcggtcttccccctggcgccctgctccaggagcacctctgggggcacagcggccctgggctgcctggtcaaggactactccactgtacagtctgagcggctggcaaggcgcatagnnnnn

SEQ ID NO: 148666 - DNA, 560 bp, Homo sapiens
  misc_feature: GYAE6OF02GJU3O.25.57.F02.1.454.CMB.1.raw
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (238)..(239): a, c, t, g, unknown or other
  misc_feature (238)..(239): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (257)..(258): a, c, t, g, unknown or other
  misc_feature (257)..(258): n is a, c, g, or t
  modified_base (261)..(262): a, c, t, g, unknown or other
  misc_feature (261)..(262): n is a, c, g, or t
  modified_base (264)..(265): a, c, t, g, unknown or other
  misc_feature (264)..(265): n is a, c, g, or t
  modified_base (267)..(268): a, c, t, g, unknown or other
  misc_feature (267)..(268): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (284)..(285): a, c, t, g, unknown or other
  misc_feature (284)..(285): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagactgtacagtcacgaccggtgctcgatttagctcgatatagttaggtttgggggaagaagggaagactgaccggtcctcccaggagttcaggtgctgggcaccttgggcgaccgggggaggtgtgtcacaaggatttgggctctgggcacagcggccctgggctgaccttggtcaaggactacttccactgtaccagtctcgagccgggctggcaaggcgcagtagcngnantnntgcgcagcgagntacncnntgnngnnannanacgagacncncacnnatatagctctcgtganangcgcactacgagtanagngngngngacgacganagagtatacactactcacactacacgacacgcgacgacgacgacgtacgtacgtacgttacgtacgttaacttacgttactacgtactaactaacttaactaacgttacgttacgttaccgtacgttacgtaaccgtaccgtaacggtacgtaacggtacgtaagtacgaacgtacgtacgtacgtacgtacgtacgacgtacgtacgtacgtcgttacgtacg

SEQ ID NO: 148667 - DNA, 221 bp, Homo sapiens
  misc_feature: GYAE6OF02JEBHS.25.57.F02.1.454.CMB.1.raw
  modified_base (220)..(221): a, c, t, g, unknown or other
  misc_feature (220)..(221): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnn

SEQ ID NO: 148668 - DNA, 225 bp, Homo sapiens
  misc_feature: GYAE6OF02HQJPW.25.57.F02.1.454.CMB.1.raw
  modified_base (219)..(225): a, c, t, g, unknown or other
  misc_feature (219)..(225): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnnnn

SEQ ID NO: 148669 - DNA, 222 bp, Homo sapiens
  misc_feature: GYAE6OF02FSS0W.25.57.F02.1.454.CMB.1.raw
  modified_base (220)..(222): a, c, t, g, unknown or other
  misc_feature (220)..(222): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnn

SEQ ID NO: 148670 - DNA, 220 bp, Homo sapiens; identical to SEQ ID NO: 148609
  misc_feature: GYAE6OF02G521Z.25.57.F02.1.454.CMB.1.raw
  modified_base (218)..(220): a, c, t, g, unknown or other
  misc_feature (218)..(220): n is a, c, g, or t

SEQ ID NO: 148671 - DNA, 220 bp, Homo sapiens; identical to SEQ ID NO: 148618
  misc_feature: GYAE6OF02HVYCZ.25.57.F02.1.454.CMB.1.raw
  modified_base (219)..(220): a, c, t, g, unknown or other
  misc_feature (219)..(220): n is a, c, g, or t

SEQ ID NO: 148672 - DNA, 347 bp, Homo sapiens
  misc_feature: GYAE6OF02GMOHG.25.57.F02.1.454.CMB.1.raw
  modified_base (342)..(347): a, c, t, g, unknown or other
  misc_feature (342)..(347): n is a, c, g, or t
tcagactgtacagtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcaccctggtcacggtctcgtcagcttccaccaagggcccatcggtcttccccctggcgccctgctcaaggagcacctctggggcacagcggccctgggctgcctggtcaggctacttcactgtacagtctgagcgggctggcaaggcgcatagnnnnnn

SEQ ID NO: 148673 - DNA, 219 bp, Homo sapiens
  misc_feature: GYAE6OF02ISZ6Z.25.57.F02.1.454.CMB.1.raw
  modified_base (219)..(219): a, c, t, g, unknown or other
  misc_feature (219)..(219): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagn

SEQ ID NO: 148674 - DNA, 255 bp, Homo sapiens
  misc_feature: GYAE6OF02G7PKM.25.57.F02.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (220)..(255): a, c, t, g, unknown or other
  misc_feature (220)..(255): n is a, c, g, or t
tcagactgtacagtcacgaccggtgctcgatttagctcgatatagttgggttgggggaagaggaagactggacggtcctcccaggacgttcgaggtgcttgggcaccttgggcacggggaggtgtgtcagaagatttgggctctgggcacacgcggccctggctgcctggtcaaaggctacttccagtgtacagtcctgancggctggcaaggcnatagnnnnnnnnnnnnnnnnnnnnnnnnnnnnnnnnnnnn

SEQ ID NO: 148675 - DNA, 197 bp, Homo sapiens; identical to SEQ ID NO: 148631
  misc_feature: GYAE6OF02GF0FL.25.57.F02.1.454.CMB.1.raw
  modified_base (195)..(197): a, c, t, g, unknown or other
  misc_feature (195)..(197): n is a, c, g, or t

SEQ ID NO: 148676 - DNA, 353 bp, Homo sapiens
  misc_feature: GYAE6OF02G7NOK.25.57.F02.1.454.CMB.1.raw
  modified_base (347)..(353): a, c, t, g, unknown or other
  misc_feature (347)..(353): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcaccctggtcacggtctcgtcagcttccaccaaggcccatcggtcttcccctggcgccctgctccaggacgcacctctgggggcacgagcggccctgggctgcctggtcaaggactacttccactgtacagtctgagcggctggcaagcgcatagnnnnnnn

SEQ ID NO: 148677 - DNA, 236 bp, Homo sapiens
  misc_feature: GYAE6OF02GNECV.25.57.F02.1.454.CMB.1.raw
  modified_base (229)..(236): a, c, t, g, unknown or other
  misc_feature (229)..(236): n is a, c, g, or t
tcagactgtacagtcacgaccggtgctcgatttagctcgatatagttgggtttggggactactgggccagggtaccctggccatcgtctcctcagcctccaccaagggcccatcggtcttccccctggcgccctgctccaggagcacctccgagagcacagcggccctgggctgcctggtcaaggctacttccactgtacagtctgagcgggctggcaaggcgcatagnnnnnnnn

SEQ ID NO: 148678 - DNA, 219 bp, Homo sapiens; identical to SEQ ID NO: 148673
  misc_feature: GYAE6OF02HQCRG.25.57.F02.1.454.CMB.1.raw
  modified_base (219)..(219): a, c, t, g, unknown or other
  misc_feature (219)..(219): n is a, c, g, or t

SEQ ID NO: 148679 - DNA, 239 bp, Homo sapiens
  misc_feature: GYAE6OF02GMF0J.25.57.F02.1.454.CMB.1.raw
  modified_base (195)..(195): a, c, t, g, unknown or other
  misc_feature (195)..(195): n is a, c, g, or t
  modified_base (201)..(203): a, c, t, g, unknown or other
  misc_feature (201)..(203): n is a, c, g, or t
  modified_base (205)..(209): a, c, t, g, unknown or other
  misc_feature (205)..(209): n is a, c, g, or t
  modified_base (211)..(239): a, c, t, g, unknown or other
  misc_feature (211)..(239): n is a, c, g, or t
tcagactgtacagtcacgaccggtgctcgatttagctcgatatagttgggtttgggatgccagtctgagtggtccgacggtgttcggcggtagggaccgaagctgaccgtcctaggtccagccctaaggctgccccctcggtcactctggttccccgccgtcctcactgtacagtctgagcggctggctaaggcncagtgnnngnnnnnannnnnnnnnnnnnnnnnnnnnnnnnnnnn

SEQ ID NO: 148680 - DNA, 229 bp, Homo sapiens
  misc_feature: GYAE6OF02JFSU3.25.57.F02.1.454.CMB.1.raw
  modified_base (223)..(229): a, c, t, g, unknown or other
  misc_feature (223)..(229): n is a, c, g, or t
tcagactgtacagtcacgaccggtgctcgatttagctcgatatagttggggtttggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaaggcgcaatagnnnnnnn

SEQ ID NO: 148681 - DNA, 358 bp, Homo sapiens
  misc_feature: GYAE6OF02FQWZG.25.57.F02.1.454.CMB.1.raw
  modified_base (350)..(358): a, c, t, g, unknown or other
  misc_feature (350)..(358): n is a, c, g, or t
tcagactgtacagtcacgaccggtgctcgatttagctcgatatagttgggtttggggggaagaggaagactgacggtcctcccaggagttcaggtgctgggcacccttgggcacgggggaggtgtgtcacaagatttgggctctgggcaccgtgggcatgggggaggtgtgtcacaagatttgggctctgggcaccctggtcacggtctcgtcagctttcaccaagggcccatcggtcttccccctggcgccctgctccaggagcacctctgggggcacagcggccctgggctgcctggtcaaggactacttccactgtacagtctgagcgggctggcaaggcgcatagnnnnnnnnn

SEQ ID NO: 148682 - DNA, 225 bp, Homo sapiens
  misc_feature: GYAE6OF02HEBV5.25.57.F02.1.454.CMB.1.raw
  modified_base (219)..(225): a, c, t, g, unknown or other
  misc_feature (219)..(225): n is a, c, g, or t
tcagactgtacagtcacgaccggtgctcgatttagctcgatatagttgggtttgggggaagaggaagactgacggtcctcccaggagttcgggtgctgggcaccttgggcacgggggaggtgtgtcacaagatttgggctctgggcacagcggccctgggctgcctggtcaaggactacttccactgtacagtctgagcgggctggcaaggcgcatagnnnnnnn

SEQ ID NO: 148683 - DNA, 198 bp, Homo sapiens
  misc_feature: GYAE6OF02H1XR2.25.57.F02.1.454.CMB.1.raw
  modified_base (194)..(198): a, c, t, g, unknown or other
  misc_feature (194)..(198): n is a, c, g, or t
tcagactgtacagtcacgaccggtgctcgatttagctcgatatagttgggtttgggatgccagtctgagtggtccgacggtgttcggcggagggaccaagctgaccgtcctaggtcagcccaaggctgccccctggtcactctgttcccaccctcctcactgtacagtctgagcgggctggcaaggcgcatagnnnnn

SEQ ID NO: 148684 - DNA, 220 bp, Homo sapiens; identical to SEQ ID NO: 148618
  misc_feature: GYAE6OF02H5ABA.25.57.F02.1.454.CMB.1.raw
  modified_base (219)..(220): a, c, t, g, unknown or other
  misc_feature (219)..(220): n is a, c, g, or t

SEQ ID NO: 148685 - DNA, 358 bp, Homo sapiens
  misc_feature: GYAE6OF02GIBQE.25.57.F02.1.454.CMB.1.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
  modified_base (351)..(358): a, c, t, g, unknown or other
  misc_feature (351)..(358): n is a, c, g, or t
tcagactgtacagtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcaccctggtcacggtctcgtcagcttccaccaagggcccatcggtcttcccctggccnccctgctccaggagcacctctgggggcacagcggccctgggctgcctggtcaaggactacttccactcgtacagtctgacgcgggctggcaaggcgnatagnnnnnnnn

SEQ ID NO: 148686 - DNA, 616 bp, Homo sapiens
  misc_feature: GYAE6OF02FYVEN.25.57.F02.1.454.CMB.1.raw
  modified_base (274)..(274): a, c, t, g, unknown or other
  misc_feature (274)..(274): n is a, c, g, or t
  modified_base (398)..(398): a, c, t, g, unknown or other
  misc_feature (398)..(398): n is a, c, g, or t
  modified_base (406)..(407): a, c, t, g, unknown or other
  misc_feature (406)..(407): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagactgtacagtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcagtgggggaggtgtgtcacaagatttgggctctggcaccctggtccacggtctcgtcagctccaccgaacggcccagtccgtcttacccccgtggcccgccccgtgcctccgacggacnccaccgtcgcggggacacacggccgaccgtcggcgtcgtccgttggtaccaaggtacctaccttcccgaacgtacgtacctagtcgtagacggcggcgtaggaccgaaggcaacgtaagtacgntagcatanncgacgtancgagngtacncacgtagtacgacganacatacncatactaacgatacgtacgacgtaacgtagacgacgtacgtacgacgtatactaacgacgtatagacgtacgaacgtacgtacgtactataacgtaccgtacgacacgtacgtaacggacgtacgtacgtaacgtaagtaacgtacgtcgtacgtcggtacgacgtag

SEQ ID NO: 148687 - DNA, 238 bp, Homo sapiens
  misc_feature: GYAE6OF02JWOU0.25.57.F02.1.454.CMB.1.raw
  modified_base (187)..(188): a, c, t, g, unknown or other
  misc_feature (187)..(188): n is a, c, g, or t
  modified_base (191)..(193): a, c, t, g, unknown or other
  misc_feature (191)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(203): a, c, t, g, unknown or other
  misc_feature (202)..(203): n is a, c, g, or t
  modified_base (206)..(207): a, c, t, g, unknown or other
  misc_feature (206)..(207): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (215)..(238): a, c, t, g, unknown or other
  misc_feature (215)..(238): n is a, c, g, or t
tcagactgtacagtcacgaccggtgctcgatttagctcgatatagttggtttgggatgccagtctgagtggtccgacgtgttcggcggaggaccaagctgaccgtcctaggtcagcccaaggctgccccctggtcactctgttcccacctctcactgtacagtctgacgcggctggcaagcgcatgnngannnangnangtnnagnngntancgnnnnnnnnnnnnnnnnnnnnnnnn

SEQ ID NO: 148688 - DNA, 242 bp, Homo sapiens
  misc_feature: GYAE6OF02IK5SW.25.57.F02.1.454.CMB.1.raw
  modified_base (216)..(216): a, c, t, g, unknown or other
  misc_feature (216)..(216): n is a, c, g, or t
  modified_base (221)..(242): a, c, t, g, unknown or other
  misc_feature (221)..(242): n is a, c, g, or t
tcagactgtacagtcacgaccggtgctcgatttagctcgatatagttgggtttgggggggaagaggaagactgacggtcctcccaggagttcaggtgctgggcaccttgggcacgggggaggtgtgtcacaagatttgggctctgggcacagcggccctgggctgcctggtcaaaggctacttccactgtacagtctgagcgggctggcaaggcgnatagnnnnnnnnnnnnnnnnnnnnnn

SEQ ID NO: 148689 - DNA, 227 bp, Homo sapiens
  misc_feature: GYAE6OF02HE59S.25.57.F02.1.454.CMB.1.raw
  modified_base (221)..(227): a, c, t, g, unknown or other
  misc_feature (221)..(227): n is a, c, g, or t
tcagactgtacagtcacgaccggtgctcgatttagctcgatatagttgggtttgggggggaagaggaagactgacggtcctcccaggagttcaggtgctgggcaccttgggcacgggggaggtgtgtcacaagatttgggctctgggcacagcggccctgggctgcctggtcaaggactacttccactgtacagtctgagcgggctggcaaggcgcatagnnnnnnn

SEQ ID NO: 148690 - DNA, 531 bp, Homo sapiens
  misc_feature: GYAE6OF01BOOU3.35.41.D08.1.454.CMB.1.raw
  modified_base (204)..(204): a, c, t, g, unknown or other
  misc_feature (204)..(204): n is a, c, g, or t
  modified_base (326)..(326): a, c, t, g, unknown or other
  misc_feature (326)..(326): n is a, c, g, or t
  modified_base (402)..(402): a, c, t, g, unknown or other
  misc_feature (402)..(402): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacacgtagtctggtaccagcagaaacctggccaggcctccaggctcctcatctatggtgcatccaccgagggccacgtggtacncccagccaggttcagtggcaggtgggtctgggacagcttcactctcacatcagcagcctgcagtctagaatattangtactagtttatctacttgtacagtactaagtttaatcgcgtcggcccgtgccttcttcgttcgggcggtagggtacccaagggtcggaagagtacgaaaagtacgtggtaggactgacctacgtgtcg

SEQ ID NO: 148691 - DNA, 565 bp, Homo sapiens
  misc_feature: GYAE6OF01AQTGZ.35.41.D08.1.454.CMB.1.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtatcggaacacgtagtctggtaccagcagaacctggccaggctccaggctcctcatctatggtgcatccaccagggccactggtactcccagccaggttccagtggcaggtgggtctggggacnggacttcactctcaccatcagcagccctgcctagtctagaacgtatttactgactagtttacnctactgtcaagtctaagtttaagagtccgtcggcccgcgtctccgttccgttccgggacgggtacgggtaccgtaagggtcggtaagacgtaacgaaaacggtacgttacgggtcgggaccttacggaccctaaccgtgttaccg

SEQ ID NO: 148692 - DNA, 571 bp, Homo sapiens
  misc_feature: GYAE6OF01D0IXL.35.41.D08.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (407)..(407): a, c, t, g, unknown or other
  misc_feature (407)..(407): n is a, c, g, or t
  modified_base (567)..(567): a, c, t, g, unknown or other
  misc_feature (567)..(567): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggganagccatcctctcctgcagggccagtcagagtatcggaacacgtagtctggtaccagcaagaacctggccaggcctcccaggcctcctcatctatggtnctatcccaccagggccacgtggtactccccgagtccaggttcagtggcaggtgggctgggacagacttcactctacacctatcagcacgcctgcagtctagaagtnttatgacttagtttatacgtacttgtactagtctaagttttaactcggtccgtacggtcccgcggttaccttcgttcgtttcggggccggtacggggaaccgtaagggtcggtaagaacgttaacgaaaaaggtacgttaggtcggactaggccaccgtnttcg

SEQ ID NO: 148693 - DNA, 548 bp, Homo sapiens
  misc_feature: GYAE6OF01C2LY1.35.41.D08.1.454.CMB.1.raw
  modified_base (203)..(203): a, c, t, g, unknown or other
  misc_feature (203)..(203): n is a, c, g, or t
  modified_base (406)..(406): a, c, t, g, unknown or other
  misc_feature (406)..(406): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtattcggaacaacgtagtctggtaccagcagaaacctggccaggctccaggctcctcatctatggtgcatccaccgagggccactggtatcccagccaggttcagtgcagtggctgggacagacttcactctcacatcagcagcctgcagtctgaagtattatgctagtttanctacttgtcagtctaagttttaatagtcgtcggcccgtcgtccttcgttccgtttcgggaccgggtacgggtaaccgaacgggtcggaagaacgtaacgaaaaaggtacgttaggtacggacgtagacctaccgtagttacg

SEQ ID NO: 148694 - DNA, 523 bp, Homo sapiens
  misc_feature: GYAE6OF01BLBAO.35.41.D08.1.454.CMB.1.raw
  modified_base (203)..(203): a, c, t, g, unknown or other
  misc_feature (203)..(203): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtattcggaacaacgtagtctggtaccagcagaaacctggccaggctccaggctcctcatctatggtgcatccaccagggccactggtactcccagccaggttcagtggcaggtgggtctgggacagacttcactctcaccatcagcagcctgcagtctgaagtattatgactagtttatctactgtacagctagtttaatagtctcggcccgtcgtcttcgtcgttcgggcggtacgggaccgaagggtcggagagtacgaaagtacgtaggtcggactagcacctgtcg

SEQ ID NO: 148695 - DNA, 610 bp, Homo sapiens
  misc_feature: GYAE6OF01EG2XT.35.41.D08.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacacgtagtctggtaccagcagaaacctggccaggcctccaggctcctcatctatggtncatccacgagggccagtgtactcccgagccaggttcagtggcaggtggctgggacagtacttnactctacacatcagcagcctgcagtctagaagtattagngtactagtttatcacttgtctagtacgttaagtttaagtacggtccgtacgggtccccgtcgttaccgttccgttccggtttccggggaccggggtaacggggtaaacccgtaagggggttacgggtaaggtaacgttaaaccggaaaaaacggttaccgttacgggttacgggtaccttacgggaccctaacccgtagtttacccg

SEQ ID NO: 148696 - DNA, 560 bp, Homo sapiens
  misc_feature: GYAE6OF01BWSL2.35.41.D08.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (550)..(550): a, c, t, g, unknown or other
  misc_feature (550)..(550): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcagaaagtggaccaggctccaggctcctcatctttggngtgtcccacgtgggccncgtggtcgtcccagtcaggttcagtggcagtggctcgnggacagagttcactctcaccatcagtcagcctgcagtctagtaagtatttgacttagtttattactgtactagtactaataataatagtactcggtaccttccgtagtttgtcgttacgttttcgggaccgtaacggggacctaacggtcgtcggtaagacgtaccgaaacgtaactcggtacggtctacgaccncgtagtaccg

SEQ ID NO: 148697 - DNA, 618 bp, Homo sapiens
  misc_feature: GYAE6OF01DXMG3.35.41.D08.1.454.CMB.1.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtatcggaacacgtagtctggtaccagcagaaacctggccaggctccaggctccncatctatggtncatccacgagggccaacgtggtactccccgaagcccgtaagggttcaggtcggctaggtggggtctggggacaggtaccttcgacttctacacctatcgacgcacgtcctgacctaaccgtagtaagtattttacgacctaacctacttacttgtaccaactaagtacgttacacggtaccgacccgacgtactaccgacgtaccgttaccgggaccgtaaacgggaccaaccggtacgtagggtaaagtaaacgttaaaagaacggttacggtacggtacgttacggactaacccgtacttcgttacgtctttacccg

SEQ ID NO: 148698 - DNA, 562 bp, Homo sapiens
  misc_feature: GYAE6OF01DGJ7W.35.41.D08.1.454.CMB.1.raw
  modified_base (204)..(204): a, c, t, g, unknown or other
  misc_feature (204)..(204): n is a, c, g, or t
  modified_base (556)..(556): a, c, t, g, unknown or other
  misc_feature (556)..(556): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcaagaaacctggcccaggcctcccgaggcctcctcatctagtggtgcatcccaccagggccagtggtatcccagccaggttcagtgcaggtggtctgggacagacttcacttctcacctatcagcacgcctgcacgtctagaacgtattagtgtacttagtttatactacttagtctagtctaagtttaatacgtcgtcggcccgtcgtcttcgttcgtttccgggacgggacgggaccgaagggtaggagtaacgtaacgaaaagtacgtaggtcggacgttagacctacgtnttaccg

SEQ ID NO: 148699 - DNA, 532 bp, Homo sapiens
  misc_feature: GYAE6OF01CBI3R.35.41.D08.1.454.CMB.1.raw
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (527)..(527): a, c, t, g, unknown or other
  misc_feature (527)..(527): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaagccatcctctcctgcagggccagtcagagtattcggaaacaacgtagtctggtaccagcagaaacctggccaggcctccaggctcctcatctatggtgcatccacagggccactggtactcccagccaggttcagtggcaggtgggtctgggacaggacttnactctcaccatcagcagcctgcagtctagaatattatgctagtttanctatgtcagtctaagtttaanagtcgtcggcccgcgtctcgttcgtttcggcggtagggaccgaagggtcggaagtacgtaacgaaaagtacgtggtacggactagaccacgtnttccg

SEQ ID NO: 148700 - DNA, 519 bp, Homo sapiens
  misc_feature: GYAE6OF01A5BRJ.35.41.D08.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (351)..(351): a, c, t, g, unknown or other
  misc_feature (351)..(351): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagcccaccctgtctgtgtctccgagggggaanagccatcctctcctgcagggccagtcagagtattcggaacaacgtagtctggtaccagcagaaacctggccaggctccaggctcctcatctatggtncatccacagggccactggtactcccagccaggttcagtgcaggtggtcngggacaggacttcactctcacatcagcagcctgctagtctagaagtattatgactagtttatctactgtacagactaatataatgctcgcctcgtagttcgcttacgtttggaccgtaggggacctaaggcgtaggacgtatacgtaaacgtactaggtcgcgtgacc

SEQ ID NO: 148701 - DNA, 594 bp, Homo sapiens
  misc_feature: GYAE6OF01B0M8G.35.41.D08.1.454.CMB.1.raw
  modified_base (204)..(204): a, c, t, g, unknown or other
  misc_feature (204)..(204): n is a, c, g, or t
  modified_base (434)..(434): a, c, t, g, unknown or other
  misc_feature (434)..(434): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaangccatcctctctgcagggccagtcagagtatcggaaacaacgtagtctggtaccagcaagaaacctggccaggcctccgagcctcctcatctagtggtcactactcccacgacgggcctacgtcggtactcccgagtccgaggttcaggtcggcgtaggttggggtctggggacagtaccttcaccttctacacctatccgagacacgcctgactagtctagaatattangtattagtttatctagtcgtacagtacttaagttaactcgtcgttccggacccgttcgtccgttcgttcggttccgggacgggtacgggtaacgtagggtcggaagtacggtaaacgaaaacgtcgttagggtacggtcgtacgactaaccgtgttaccg

SEQ ID NO: 148702 - DNA, 602 bp, Homo sapiens
  misc_feature: GYAE6OF01C0690.35.41.D08.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcagaaacctggccaggctcccaggcctcctcatctatggtgcactccaccgngggccacgtggtactcccagcaccccggtnacggtggcagtggctcgtgggacagtagtcactctcaccatcagcagcctgcagtctagaagtgtttgcttagttttatacgttcgtactagtactaattaattaattagtccgttcgggtacccttcgggtaagtttcggacctttacggttttcggacccggtaagggggtaacccgtaaagggtcgttaaggggaacgtaacgttaaaccgaaaaccggtaacgttacggtaggtaccgtgtacccgtaaacccg

SEQ ID NO: 148703 - DNA, 568 bp, Homo sapiens
  misc_feature: GYAE6OF01D4B0Y.35.41.D08.1.454.CMB.1.raw
  modified_base (350)..(350): a, c, t, g, unknown or other
  misc_feature (350)..(350): n is a, c, g, or t
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggagccatcctctctgcagggccagtcagagtattacggaacaacgtgtctaggtaccagcaagaaacctggaccaggcctcccgaggcctcctcattcgtttggtgtcgtccacgtagggccctgtggtctcccagtcaggttcaggtgcnggtggctcgtgggacaggtagttccacgttcctccaacctagtcacgcacgtcctgcctagtctagtaagttntttgcttagtttattacgtgtcagtctagtttaangtcgtcggcccgngtcttcgttcgttcggcggtacggaccgtagggtcgtaagtagtaacggaaagtacgtggtcgtacgtcgacctacgtacttcgttgttccttaccg

SEQ ID NO: 148704 - DNA, 585 bp, Homo sapiens
  misc_feature: GYAE6OF01A5CA1.35.41.D08.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacacgtagtctggtaccagcagaacctggccaggctcccgaggcctcctcatctatggtncactccacgagggcccatggtactcccagccaggttcagtggctaggtcgggtctggggacaggtaccttcaccgtctaccacctatcacgcagcctgctagtctagaagtattagngtactagtttacnctacgtgtactagtacgttaagttttaactacggtccgttcggcccggtccgtccttcgttccgtttccgggaccggtacgggtaacccgtaggggtacggaagtaacgtaacgaaaacgtacgtacggtacggacctagccaaccgtctacg

SEQ ID NO: 148705 - DNA, 735 bp, Homo sapiens
  misc_feature: GYAE6OF01BTCSS.35.41.D08.1.454.CMB.1.raw
tcagtacagatcgtcacgaccggtgctcgatttagtcacgcgagaaagggaaagggggaggaactgctcagttaggacccagacggaaccatggaagccccagcgcagcttctcttcctcctgctattctggctcccagatatcactggagaaatagtgatgacgcagtctccaaccactctgtctgtgtctccgaggggacagacgcccaccctctcctgcagggccagtcagagtgttagcagctaacgttacgccgtggtaccagacaagtaaagttcggccaggctccccgaggcctccgtcacttccgtttggtcgttcgtccctacgtacgggcccgcgttcgggtcgtccccgtaaggtcgtacgggtttcacggttcggactaggttcggcgtttaccggtaggggaacctagggtacgtttaccaaccgttcctaccaaccctagttaccaacgtaccgtacgtcccgttcggaccgtaacggttcgttaacggtaaaggtttacgtttttacggacgtttaagtttttaacgtttacgttacgttaccgtaagtacttaaattaacgttaaacgttacgtaccgttccggtacccttccggttaagtttccgtacgttaccgttttacgggaacccgggtaacggggtaaaccctaagggttccggtaggtaacgtaacgtaaccggtaaaccgtaacgtacggttcgggaccgttcgaaacccg

SEQ ID NO: 148706 - DNA, 567 bp, Homo sapiens
  misc_feature: GYAE6OF01C6PYA.35.41.D08.1.454.CMB.1.raw
  modified_base (205)..(205): a, c, t, g, unknown or other
  misc_feature (205)..(205): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (559)..(559): a, c, t, g, unknown or other
  misc_feature (559)..(559): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggggaanagccatcctctcctgcagggccagtcagagtatcggaacacgtagtctggtaccagcaagaacctggccaggctccaggctcncatctatggtncatccacagggccactggtactcccagccaggttcagtggcagtgggtctgggacngacttcacttcncaccntcagcacgcctagcagtctagaagtattatgctagtttacnctactgtacagtctaagtttaatacgtcgtcggcccgcgtccttcgttcgtttccgggccggtacggggaaccctaaggggtcggaacgtaacgttaacggaaaaacggtaacggttacggtagggtacctcggtacctaaccgtnttacccgg

SEQ ID NO: 148707 - DNA, 799 bp, Homo sapiens
  misc_feature: GYAE6OF01DEDPQ.35.41.D08.1.454.CMB.1.raw
  modified_base (202)..(202): a, c, t, g, unknown or other
  misc_feature (202)..(202): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctccagataccactggagaaatagtgatgacgcagtctccagccaccctgtctgtgtctccgaggggganagccatcctctcctgcgacgggccaagtcagtagtattcggaaactaacgtagtcgtggtaccagcaagaaacccgtggccaggcctcccgaggtcctcctcatctagtggtacgcactcccaaccgtacggggccctaacgtcgggttaacctcccccgacggtacccgtaacgggtttccaacgggttcgggaccgtaaggggttcgggggttacccgttacgggggaacctacgggtaacctttacccgaccgtttaccctacctaaaccctagttacccgacggtaccctaaccggtccccgttggtaccgtacgggttacccttacgggtaaaagttaacgttttacgtaggttactttaaacggtttttacacccgttaagtttcggtaccgtacgttaacgtttaaacggttttaaacgtacggtaccgttaccggggcccccgtaacggttcccgtttcccggttccggttttaccggggaccggggtaaccgggtaacccggtaggggttaacggaacgggttaactaaaaccggaaaacggtacgttacggtacggtacggtaccgaccgtaacgtacgtttacccg

SEQ ID NO: 148708 - DNA, 720 bp, Homo sapiens
  misc_feature: GYAE6OF01CK383.35.41.D08.1.454.CMB.1.raw
  modified_base (125)..(125): a, c, t, g, unknown or other
  misc_feature (125)..(125): n is a, c, g, or t
  modified_base (711)..(711): a, c, t, g, unknown or other
  misc_feature (711)..(711): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcccgtntactctggcgtcccaccgataccacctaggtaggaaaataagtgagtacgacgacacgtacgtccacgccacccctcgtgtcgtgtctccgacgggggaaggagccactacctcctcctcgcgacgggccgacgtacgagagtaagttacggtaaccgaaacgttagtcgtacgtaccgacagacgaaaaccgtccggccgaacggaccgtccccaacggctccccttacatctagtgggtcgcacctcccgaacccgaggggcctactggttacacccccacgacgtacgggtctagaggggtccaggttgggggttccgacgggacaacgtaccttcctaccgtcctcctaaaccgattcaacggctaccgtccctgacacgttacggtagaaaggtaacttatggtaccgtaagttttactcacgtgttacacggttattaaacgttttaagtaagcccggtaccgggtcccgtccgtactttccgttcggtttccggggacggggaacgggtaaccgagggtgggtaacgtaactaacgtaaaaacggtacgttggtacggtcgtaaccgacaaccccgttntccgttccg

SEQ ID NO: 148709 - DNA, 778 bp, Homo sapiens
  misc_feature: GYAE6OF01CCDFM.35.41.D08.1.454.CMB.1.raw
  modified_base (207)..(207): a, c, t, g, unknown or other
  misc_feature (207)..(207): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggcctcccagataccactggagaaatagtgatgacgcagtctccagcccaccctgtctgtcgtctaccgaggggganacgcctatcctctccgtgacagggccagtcagagtacgttcggaacacgtagtctaggtacagcaacgtaacctggacccaggcctaccgaggtcctccctctactctagtcggtcgtcgtacccgacggtacgggcctcgtcggtcgtcccaggttccaggttcaggtcggctaggtcggcgttcgtcggggacctaggtacgtttcaccgttactacgaacctacgttccgaaggtccaaccgtccgtagaccgttacgtcgttaaggtaagtttgttttacggtacttaagttttacttacgttcgttaccaaggttacttaaagtaacgttttaaacgtcgggttacccgtttacggggtaccccttaaccgggttacgttttccggtaccgttttaccgggtttacccggggtaaccccgggtaaacggggggttaaacccctaaggggttcccggttaagggggtaacccgttaaacccgggtaaacccggaaaaaccgggttaaccgggttttccggtaaccgggttcctaacccgggtaacccgtaccccgttttaaaccggg

SEQ ID NO: 148710 - DNA, 797 bp, Homo sapiens
  misc_feature: GYAE6OF01A2HIC.35.41.D08.1.454.CMB.1.raw
  modified_base (207)..(207): a, c, t, g, unknown or other
  misc_feature (207)..(207): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtcctaccacgcccaccctgtctgtgtcctcgaggggaanacgcctatccctctccgtgccgacgggcctagtcaggtagttacttacggaaactacggttagtccttacgggtaaccagacaacgtaaaccgtcggaccaacgggtcctacccgacggtccttccgtactacgttcgttagtcggttcgacctaccgttaccccggaccgtaccgggtacctacgttacgggttaaccctaccccgaacgtccggttaacggttccgaacggtcggtaccgtaaggggttccgggtacgtacggggaaaccgtacggttacctaccgtaacctttcccgtaacctaccgtaacgtccgaaccgtacgtaccgttcccgtcgaaccgtaacgtttaccgtaaagtaaggttaacttaacggttagttaaacgtttaccttaccgtagttacgttacgtaacgttaacgttaacgttttaacgtacggttcccggtccgggtaccccgttcggttacctttccggttacccggttcgggtaccgggtacgggtaacggaacgggtaggtacgtaacggtaaactaaagggtacgtgtacgggtacctacggacctaacgtcgttccgttcg

SEQ ID NO: 148711 - DNA, 757 bp, Homo sapiens
  misc_feature: GYAE6OF01EDQXI.35.41.D08.1.454.CMB.1.raw
  modified_base (202)..(202): a, c, t, g, unknown or other
  misc_feature (202)..(202): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggganagccatcctctctgcgacgggccagtcagtagttacgttacggaactaacgtagtctaggtaccagcaagaaccgtggaccaggcctaccgaggtcctccgtacattcctagtcgggtgaccacgtcccgaaccgacgggccctaacgttacggtactccccgagtacccgtagggtttcaaggtcggacgtaggggttcggggtaccgtaggggaacctaggttacctttacgacccttccgtaccaaccgtactaccgtaacgccgacgtcccgtagaccgtagtaccgtaaggtaagttatttagtcgtacgtttacgtttactaccgttacgtcgtaccgtagttaacggtttaatttaacgtacggtccgttaccgggacccgttccgttaccgtttcccggtttaccgggtttacccggggaaccggggtaaaccgggtaaccggttaaacggggtacgggtaaaccgtaaacggttaaaccggtaaaaaccgggtccgttaacgggtaccggtaccgttaaccggaccctaaccgtacgtttacccgg

SEQ ID NO: 148712 - DNA, 829 bp, Homo sapiens
  misc_feature: GYAE6OF01A6KQC.35.41.D08.1.454.CMB.1.raw
  modified_base (204)..(204): a, c, t, g, unknown or other
  misc_feature (204)..(204): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagactaccactggagaaatagtgatgacgcagtctccagcccacctgtctgtgtctccgaggggaanacgccatcctctcctgccgaggccagtacagagtattacggaacaacgtagtctaggaccagacaagaaacctggtcaggtcctccaggtcctcctcatctatcggcgacactccaccgacgggtccacgttacggtacctcccgacgtccgtacggttccgagggttacggaccgtaggggttcggggtcggtacgggggtaacgtacggtacgtttccaaccgttcctaccgtaacccgtactacgaacggtaccgtacgtcccgtcggtaccgaaggtttccgtaggtaacgtttacggtttaacgttttcggtacgtttaagttttaacttacggtttcggttaacgttacggtaacttaacgtttaacgtacggttaaaccgtaacccgggtttaccggttacccgggtttacgggttaccggggttaaccccgggtttacccggggtaacccgggtaaaaacgggggttaccccgggttaaaacggggggttaaacggtaaaccccgggtttaaacccggaaaaccgggtttaccggtttacccggggttacccggggtaacccgtttacccgggaaacccttaaccggttacgttccccggttttcggtttacccccg

SEQ ID NO: 148713 - DNA, 769 bp, Homo sapiens
  misc_feature: GYAE6OF01A27JH.35.41.D08.1.454.CMB.1.raw
  modified_base (210)..(210): a, c, t, g, unknown or other
  misc_feature (210)..(210): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccagtggaagaaatagtgatgacgcagtctccagccctaccctgtctgtcgtctaccggagggggaancgcctatccctctccgtgcgacgggccagtcgagagttactacggaactacggtagtctaggaccagacaagaaaaccgtcggaccacgggcctaccgacggtccttaccctcgacttcgtacgtgggttcactaccgtaccccgaaccggaccggggacccgtcggttcgggtccgtacccgtaggtaccgtaggttcgtacgggtcggacgtagggtcggtaccgtggtacgggtacgtaacggttacgttaccctaacgttcccgaccctaacctacttacgaaccgtacgaccgtccgtgaccgttacgttaccggttaaggttaacgtttaacgttttcgtaacgttttaacgttttaacgtttaaccggttcgttaacgtaacgttaaactaaaagtttaaggtaaaccgttcggtacccgtacggttcccgttaaacgggttgtttaccgtaccgttcggtttaccgggaaccgggtacggtaacctagggtctaacggggataaacgaaccgtaaacggtcgttacgggataacggtccgtcctaaaccgg

SEQ ID NO: 148714 - DNA, 644 bp, Homo sapiens
  misc_feature: GYAE6OF01E4LY3.35.41.D08.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (469)..(469): a, c, t, g, unknown or other
  misc_feature (469)..(469): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtgtctggtaccagcaagaaacctggccaggcctcccgaggctccctnactcctagtcgggtcacactcccgaccgaggggacccaacgttgggtaactcccccgagccccgtaggttccgaggtgggcctagggttcggggtcctagggggactacggtacttacaccgtcctccgaacctagtccacgtcacggtccgtcgctagtcgtagaatatttangtcttaagtttacttactgttacacgtactaattacttaaagtacgtcgtacggtcccttacggtagttcggtacgttaccggttttcgggaccccgggtaaggggtacccgtaagtgggtacgggtagtaacttaccgaaaacggtaactgggttaccggcctggacctacccg

SEQ ID NO: 148715 - DNA, 765 bp, Homo sapiens
  misc_feature: GYAE6OF01EMXDJ.35.41.D08.1.454.CMB.1.raw
  modified_base (177)..(177): a, c, t, g, unknown or other
  misc_feature (177)..(177): n is a, c, g, or t
  modified_base (518)..(518): a, c, t, g, unknown or other
  misc_feature (518)..(518): n is a, c, g, or t
  modified_base (753)..(753): a, c, t, g, unknown or other
  misc_feature (753)..(753): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgcctactcgtggcctcccagactaccactggaagaaatagtgatgacgcagttcnccagccacctgtctgtcgtctccggaggggaacacggcctacttccctccgtccaggccgtagggcctagtcgaaggtacgtaacgttcgggaaactacggttacgtccgtaggtaaccacgtacaacggaacccgtggaccgacgtcccgtccaacggccttaccctctaacttcttacgtcgggtactacaccttcccggaaccgtacggggtacctaccgttcggtaacctccgacgtccggttaacggttcgacgggtcgcggtaacggggttcgggtacgtacgggtactacggttacctcggtacctccgttaccaacctgtcgacgaccgtacncctacggtatcgttacgtaagtaacgtaagttactacgtacgttaacgtttacgtacgttaccgttacgttaccgtagttacgtttaaaggttttacggaccgtccgggtacccggtaccctcggtttacccgtcggtttaccgggttaccgggaccggggttaaccgggaccgtaaagggggtactaaggaacgtaaacgtaacggtaacgtcggtacggtaccgagtaacccngttaaccgttcc

SEQ ID NO: 148716 - DNA, 790 bp, Homo sapiens
  misc_feature: GYAE6OF01D0L90.35.41.D08.1.454.CMB.1.raw
  modified_base (240)..(240): a, c, t, g, unknown or other
  misc_feature (240)..(240): n is a, c, g, or t
  modified_base (658)..(658): a, c, t, g, unknown or other
  misc_feature (658)..(658): n is a, c, g, or t
tcagtacagatcgtcacgaccggtgctcgatttagtcacgcgagaaagggaaagggggaggaactgctcagttaggacccagacggaaccatggaacgccccagcgcagtcttctcttcctcctgcttactctggcctcccagactaccactaggagaaatagtgatgacgcagtctccacgcccacccttgtactgtcgtccgtaccggaagggggaacacgtcctactcctcctaccncggacgcgggacctagtcgaagtacgttacgttaccggaaactaacggtagtaccgtacggtaaccagaccgaaacgaaacccggttggacccgtacggaccctacccgtaacggtcctcccttaacaagttccgttaagtcgggtactaacctacctaacccggaaccgaccgggtacctaacggtaccgttacctacccgaacggtaccgttaaggttaccgaggttacggtacggttacggggtcgggggttacgttacggggaaccgttaaccgttacctttacccggacctttccggaactaccgtacgttacccgagaccgtacgtaccgtcgacgtacgtagtaacgtaatagttaacgtacgtgttaacgttatactacgtacgtagtacgtttaagtaagttttaacgngtaccgtccggtacccgtcgttaacccgttcggttacccggttcgggaacgggtaccgggaacgttagggacggaaagtacgaaacggtaaacgtacgttaggtacccgtaggtacaccctggttccttacg

SEQ ID NO: 148717 - DNA, 586 bp, Homo sapiens
  misc_feature: GYAE6OF02JB01H.35.41.D08.1.454.CMB.1.raw
  modified_base (203)..(203): a, c, t, g, unknown or other
  misc_feature (203)..(203): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtattcggaacaacgtagtctggtaccagcagaaacctggccaggctcccaggctcctcatctatggtgcatcccaccagggccacgtggtactcccagccaggttcagtggcaggtgggtctgggacagacttcactctcaccatcagcagcctgcagtctagaagtattatgctagtttatcactgtacagtctaagtttaactagtcgtcgggccccgtcgtccttcgttccgttttccggggaccgggtacggggtaacccgtaaggggttcgggaacggtaacgtaaccggaaaaacggtaccgttacgggttacgggaccgttacgggaccctacccgtacgttaccg

SEQ ID NO: 148718 - DNA, 514 bp, Homo sapiens
  misc_feature: GYAE6OF02GONCQ.35.41.D08.1.454.CMB.1.raw
  modified_base (317)..(317): a, c, t, g, unknown or other
  misc_feature (317)..(317): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccaaccactctgtctgtgtctccaggggacagagccaccctctcctgcagggccagtcagagtgttagcagcaacttagcctggtaccagcagaagtggccaggctcccaggctcctcatctttggtgtgtcccacgtaggggccnctgggtgtccccagtcaggttcagtggcagtggctcgtgggacagagttcactctcaccatcagcagcctgcagtctagaagtattttgcttagtttattactgtcagcaatataatagctggccttcgattgctacgtttcggccgagggaccaaggcgtaggagtatacgaaacgtacgttggtggctgcctacc

SEQ ID NO: 148719 - DNA, 589 bp, Homo sapiens
  misc_feature: GYAE6OF02H2AB1.35.41.D08.1.454.CMB.1.raw
tcagtacagatcgtcacgaccggtgctcgatttagtcacgcgagaaagggaaagggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggcctcctcattcgtttggtgtcgtccacgtacggggcccgtcgttgggtcgtccccaggttccgtagggttcaggtgggctaggtggctcgtggggacaggtagttcacttctacacctatcagcacgcctgcagtctagaagtatttgcttagtttattacttgtacagtactaaatataatagtacgtcggtccttccggtagttcgtacttacgttttcggaccggtacggggtaaccgtaacggtcggtacggtaagacgttaacgaaacggtaaccgttaggtacggtcgtacgtacccg

SEQ ID NO: 148720 - DNA, 544 bp, Homo sapiens
  misc_feature: GYAE6OF02INLW8.35.41.D08.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtatcggaacaacgtagtctggtaccagcagaaacctggccaggcctcccaggcctcctcattctttggtntgtccagtagggcctntggtntcccagtcaggttcagtgcagtggctcgtgggacnggtagttcactctcaccntcagcagcctgcagtctgtaagtatttgctagtttattacttgtcagtactaatataatagctcggcctcgtagttgacttacgtttcggaccgtaggggacctaaggtccgtgggacgtactaacgaaacgtacgtcggtacggtccgtaggacctaccgtatccg

SEQ ID NO: 148721 - DNA, 652 bp, Homo sapiens
  misc_feature: GYAE6OF02IZDY2.35.41.D08.1.454.CMB.1.raw
  modified_base (203)..(203): a, c, t, g, unknown or other
  misc_feature (203)..(203): n is a, c, g, or t
tcagtacagatcgtcacgaccggtgctcgatttagtcacgcgagaaagggaaaggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcaagaaacctggccaggctcccaggctcctcatctatggtgcatcccaccagggccacgtggtactcccagccaggttcagtcggctaggtcgggtcgtgggacacgtacttcacctcgtaccaccgtatccgacgcgagcccgtgactagtcctagaacgtattagtcgtacgttaacgttttatacccgtacgttcgtaccaggttacgttaagtttttaaagtacgttccgttaccgggtccccggtacgtcccgttccgttaccggtttccggggacccgggtacggggtacccgtaaggggttacgggtaaggtaaaccgttaacggtaaaaacggttaccgttaggtaccgggttaccgtacggacccgtaccgtatttacccgg

SEQ ID NO: 148722 - DNA, 549 bp, Homo sapiens
  misc_feature: GYAE6OF02IWITT.35.41.D08.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccagggggaanagccatcctctcctgcagggccagtcagagtattcggaacaacgtagtctggtaccagcaagaaacctggaccaggctccccgaggctcctcatctatggtncatcccaccgagggccactggtactcccagccaggttcagtggcagtcggctcgtgggacngtagttcactctcaccatcagcagcctgcagtctagaagtatttgcttagtttattactgtacagtacaatactaatagacgtcggtacctccgtagttcgtctacgtttcggaccgtagggtaccgtaaggtccgttaggaagtacgtacgaaacgtacgtcggtaggccgtagacctaacg

SEQ ID NO: 148723 - DNA, 572 bp, Homo sapiens
  misc_feature: GYAE6OF02IFH4M.35.41.D08.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctcctcctgcagggccagtcagagtattcggaacaacgtagtctggtaccagcagaaacctggccaggctcccaggctccgtcatctatggtnccatccaccagggccactggtactcccagccaggttcagtgcagtggtcngggacaggacttcactctcacatcagcagcctgcagtctgaacgtattatgacttagtttatcctagtcgtacagtactaagttttaactagtaccgttcgggaccccgtcgtccttacccgttcgtttccgggaccgggtagggacccgtaagggtcgggaagtacgtaaccgaaagtaacgtcgggtacggtccgtacggacctaccgtattaccg

SEQ ID NO: 148724 - DNA, 584 bp, Homo sapiens
  misc_feature: GYAE6OF02GHHTS.35.41.D08.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcgagggccagtcagagtattcggaacacgtagtctggtaccagcaacgaaacctggccaggcctccaggcctcctcatctatggtnccatcccacgacgggccactggtactcccagccgaggttcagtgacgagtgggtcagggacngtactcactcnccacntcagcacgtcctgctagtctagaacgtattagngtacttagtttatactacgttgtcagttacgttaagtttaacgtcgtcgtccggtaccccgtcgtccttccgttccggttacgggacgggtacgggtacggagggttggaacgtaacgtaacgaaaacgtaggttacggtacggtactacggaacctacgtacttcgg

SEQ ID NO: 148725 - DNA, 707 bp, Homo sapiens
  misc_feature: GYAE6OF02HG3XM.35.41.D08.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaancgccatcctctcctgcagggccagtcagagttactcggaacaacgtagtctggtaccagcaagaaacctggaccaggcctcccgaggcctcctcattctagtggtcnctactcccaccgacgggcctacgttggtactcccgaggccctaggttccaggtcggactaggggttcgggtacgtggggaactaggtacctttccaaccttcctaccgaacccaattcccgaaggtccaacggtcccgtaggacctaacggttccttaaggaaacgttactttaagtacggtaccgttaacggtttaccaacgttccctaacgttcggtaccgtaagttaccgtttaaagtttttaacggacgtccggttacccgggccccgtcgttacctttcccggttaccggtttccgggaccggggttaacgggtacccggtaagggttcggaacggtaacgttaaaccgaaaggtacggttcggtacggtacttacggaccgtaccgtacg

SEQ ID NO: 148726 - DNA, 746 bp, Homo sapiens
  misc_feature: GYAE6OF02IMC1K.35.41.D08.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcacgggccagtcagagtatcggaacaacgtgtctggtaccagcaagaacctggaccaggcctccgaggcctcctcattcagtggtnaccactcccaccgagggccctaacgttcgggtactacccgacggccgtaagggttccgtaggcgggtaccgtaaggggtttcggggtaccggttaggggggaactaaccgggttactttacccgaacgtttccgttaaccccacccggtaattacccgaacggggacccaacgggttccctacgtacccggaacggttccttaagggaaaacggtttacgtttaatcggtacgtttaaacggtttactaccgtaacgttcgttaccgaggttaaccttaagtttaaacgttcgaccggttaccggcccttaggtccctttacgttcccggtttacgggaccggggtaccgggttaaccggaagggttacgggaaacgtacgtaaaccggtaaaacgacccgtttaggccgggtacttacggaccttacccgaaggtttccg

SEQ ID NO: 148727 - DNA, 828 bp, Homo sapiens
  misc_feature: GYAE6OF02I05JU.35.41.D08.1.454.CMB.1.raw
tcagtacagatcgtcacgaccggtgctcgatttagtcacgcgagaaagggaaagggggaggaactgctcagttaggacccagacggaaccatggaagccccagcgcagcttctcttcctcctgctattctggctcccagatatcactggagaaatagtgatgacgcagtctccaaccactctgtctgtgtctccaggggacagacgccaccctctcctgcacgggccagtcagagtgttagcagcaacttagcctggtaccagtcaggaaagttggaccaggcctccgaggccttcctacacttcgtttggtcgtcgtcccacggttacgggcccgtcgtgggtctcccgagttccgagggtttccaggttcggcgtacggttcggcttacggtgggaacctaggtacggtttacccacgttctacccgtaaccgtatcccgaaaggtccgtaacggtcccgttacgggacctacgggttaccgttacggtaaacggtttaagtttttacggtaacgttttaacgggtttttaactttaaccggtttacggttaaccgtaaccgggttaacttaaaaacgtttaaacgtttaaaacggttaagttaacccggtttaccggggttaacccgtttaacccgggtaaacgggttttccgggtaaccccgtttttacgggttttttaccggggaaccccggggttaacggggggtaaaccccgtaaacggggtacccgggttaacggggtaacggttaaaccggttaacccggtaaaacccgggttaaaccggttacggggttaacgggttacccgtaccggtaaaccccgg

SEQ ID NO: 148728 - DNA, 706 bp, Homo sapiens
  misc_feature: GYAE6OF02GS80T.35.41.D08.1.454.CMB.1.raw
  modified_base (204)..(204): a, c, t, g, unknown or other
  misc_feature (204)..(204): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacacgtagtctggtaccagcaagaaacctggaccaggcctcccgaggcctccncattcgtagtcggtncactcccacgagggcccatcggtactcccagcccaggttccagtcggacaggtcggggtctacggggactaacggtacctttacgaccgttcctaccgaaccctagtaccgacgctaacgtcccgtacgaccgtacgttacgttaaggtaaagtaactttaacgtcgtaacttaacggttttaactccttaccgttgttactacgtacgttaaagttttaacgtacggtaccgttaccgggtacccgtacgttcccgtaccggttttacccgttaccggggtacccggggtacgggaacccgggtaacggggtacgggtaacggtaacgtaaccggtaaaaacggtacgttacgggtacggtaccggttacggaaccgttacccttagttacccgg

SEQ ID NO: 148729 - DNA, 607 bp, Homo sapiens
  misc_feature: GYAE6OF02HBR7H.35.41.D08.1.454.CMB.1.raw
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctcgagggggaagccatccctctcctgcagggccagtcagagtattcggaacagtagtctggtaccagcagaaacctggccaggcctcccgaggtcctcctcatctagtggtcncactcccaccgagggcccacgtggtactcccgagcctaggttccaggtcgacgaggtgggtctgggacaggtaccttcgacttcnccaccgtatccaagcgacgcctgcctagtcagagtattactgtacttagttactctacgttgtcacgtattaagtttaatacgccgttcgggacctcgttccgttaccttcgggttccgggaccgggtacgggtaccgtaaggggttcggaacgtaaacggttactaaaacggtacggttacggttacggtactaccggtacctaccgttacgttccg

SEQ ID NO: 148730 - DNA, 565 bp, Homo sapiens
  misc_feature: GYAE6OF02FGPC9.35.41.D08.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacacagtctccagccaccctgtctgtgtctccgagggggaanagccatcctctcctgcagggccagtcagagtattcggaacacgtagtctggtaccagcagaaacctggccaggcctcccaggcctcctcatctatggtncatccaccngggcccagtggtatccccagcccaggttcaggtcggcaggtgggtctgggacaggtacttcactctccaccatcagcagcctgctagtctgaagtattatgactaggtttatctatgtacaggtctaagtttaatacgtctcgggccctcgtcctcgttcgtttcgggacgggtacgggaccgtaggggtcggaacgtaacgtaaccgaaaacgtacgttagggtcggtaccgtgaccctacctagtttcccg

SEQ ID NO: 148731 - DNA, 605 bp, Homo sapiens
  misc_feature: GYAE6OF02I2FKR.35.41.D08.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
  modified_base (480)..(480): a, c, t, g, unknown or other
  misc_feature (480)..(480): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatgtgatgacgcagtctccagccaccctgtctgtgtctccgagggggaanagccatcctctcctgcagggccagtcagagtactcggaacacgtagtctaggtaccagcaagaacctggaccaggcctccaggcctccnactcagtggncatccgacgaggccactggtactcccgagtcctaggttccaggtcgnaggtgggctgggacncggtcttacgacttctacgacagtcacgcacgtcctggctagtcgtagaacgttnttaacgcgtacttaaggttttaacnccgtacgttcgtaacctaggttacttaacgttaacncggtccgtaccggcccgtacgtccttcgttacggttaccgggacggtaccgggtaacgttacggtggtaacgtaagtaaccgaaacgtacgttcggtcggtacctacggacccttagtagttccg

SEQ ID NO: 148732 - DNA, 774 bp, Homo sapiens
  misc_feature: GYAE6OF02JZGAZ.35.41.D08.1.454.CMB.1.raw
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatgtgatgacgcagtctccagccacctgtctgtntctccgagggggaanacgccatcctctcctgcgaggccagtcagagtattcggaactaacgtagtctaggtaccagacaacgaaaccgtggaccaacggtcctaccccgaggccttccgtactactcctagtcgggtacgtaccacgtacccgaccggacgggccctaacgtcgggtaacctccccggaacgtacccgttaaggttccgaacggttcggaccgtagggtacgggttcgtacggggtaacctacggtactttacccgaacctttcccgtaaccgtaaccctacggtttaccaacggtaccgaccgtaccgtacgtacgtacgttcgttaagaaggttaacttaggtacgtcgttaatttacgaacgttccgttagtacccgtagttaacgttaaacggttttaacacggtttacccgtccggggtaccccgttccggttaccgtttaccgttaccggggtttcccgggaaccgggaaccgggttaaccggtaacggggtaacgggaaccttaaggtaaaacccgtaaagggtcccgtagggtaccgtacgtaccggtacctaccggttacgttacccg

SEQ ID NO: 148733 - DNA, 812 bp, Homo sapiens
  misc_feature: GYAE6OF02IDAE9.35.41.D08.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccacctgtctgtgtctcgagggggaanagccatcctntcctgcagggccagtcaagtatattcggaacaacgtagtctggtaccagcaagaaacctggccaggcctccaggtctcctcacttctagtggtgacctagtcccaccgacggcctacgtacggtactccccgaggaccgtaggttcgaaggttcggaccgtaggttcggggtcgtacggggaactacggtaacctttccgaaccgttcttacccgaaccctacgtttaccgacggtacctaacggtcccgtacggtaccgtaacggtttccgtaaaggtaaaggttaaccgtttaagttcgtaaccgtttaaggtttttaacctacgttaacctttacggttaccgtaaacggtacgtttaaacggtttttaaacgtccggttaccggttccggggtaccccgttaccggttacccgttttaccggtttcccgggtttttaacccgggggacccggggtaaccgggggtaaccccgttaaaggggggttacggtaaacgtaaacgggtttaaacccggtaaaaacgggtttaaccggtttaggggtaaccggttaccggttaaccccgggtaaccttaaccccggttagtttaaccccgg

SEQ ID NO: 148734 - DNA, 839 bp, Homo sapiens
  misc_feature: GYAE6OF02IEJAL.35.41.D08.1.454.CMB.1.raw
  modified_base (156)..(156): a, c, t, g, unknown or other
  misc_feature (156)..(156): n is a, c, g, or t
  modified_base (203)..(203): a, c, t, g, unknown or other
  misc_feature (203)..(203): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctccgaggaaccactggagaaacngtgatgacgcagtctccagccatcctgtctgtgtctccgaggggganagacgcccaccctctcctgcagggccagtcagactattacgtacccaattagcctggtatcagcaagaaaccgtggtacacggtcctaccccgaggtacttcccgtactacttccgtaagttcgggttacgcctaactaccccgaacccggacggggtacccctaacggttcgggttaaccctcccccgaacggtcccgttaagggtttccaagggttcgggaccgtaggggttcggggttacgtacgggggaactagggttacgtttaccaccgttccgtacccgaaccctaagtccgacggtaccctaccggtacccgttcggaccgttacggttaccgtagtaacgtttaggtttaacgtttttcggtacgttttaacggtttttaactttaccgttacggttaccgtaacgttaacctaaagtttaaacgtttaaacgttaccgttcccggttaccggtacccgtttaaccggtacggtttaccgtaccgtttaaccgggtttttccgggaacccgggttaaccgggggtaacccgttaacgggttaccggtaacgggtaacgtaaccggttaaacccggtaaaccggttaaccggttaccgggtaccgggttaccgttaccggtaaccccg

SEQ ID NO: 148735 - DNA, 816 bp, Homo sapiens
  misc_feature: GYAE6OF02F7T57.35.41.D08.1.454.CMB.1.raw
  modified_base (204)..(204): a, c, t, g, unknown or other
  misc_feature (204)..(204): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacggtagtcgtggtaccaggaacgaaacctggacccaagggcctacccgaggtccctccgtcactctagtgggtcgcctactcccaaccggacggggaccctacgttcgggtacctccccgagtacccgtagggttccaggtcggacgtagggttcggggtctacgggggaacctacggtacctttacaccgttccgtccaaaccgtacttacccgaaggccctaaccggtcccgttacggaccgttaacggttaccgttaacggtaaaacggttactttaacggtcggttacctttaaaggttttttaactacccgttaaccgtttacggttaaccgtaacggtttaaccgtttaaaggtttttaaaaccgtacgggttcccggttacccggggtacccccgttccgtttacccgtttaccggtttcccgggttttacccgggggaccgggggtaaacccgggttaccggtaaacgggggttaggaaacgggttaaccgtaaaccggtaaaaacggttacggttacggtacggtacgtaccggtacccgaaccgttacgttcgtttacgg

SEQ ID NO: 148736 - DNA, 551 bp, Homo sapiens
  misc_feature: GYAE6OF02IZUFX.35.41.D08.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (397)..(397): a, c, t, g, unknown or other
  misc_feature (397)..(397): n is a, c, g, or t
  modified_base (448)..(448): a, c, t, g, unknown or other
  misc_feature (448)..(448): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggggaanagccatcctctcctgcagggccagtcagagtattacggaacaacgtagtctggtaccagcagaaacctggaccaggctcccaggctccncatctatggtcncactcccaccgagggccacgtggtactcccagccaggttcagtcgcaggtgggtctgggacagtacttcgactctacaccatcagcagccngcagtctagaagtattatgactagtttatctactgtcagtactagtttaanagtcgtcggccgcgtctcgttcgttcgggacggtacggtacgtaagggtcggaacgacgtaacgaaaacgtacgtacggtacggcgtacgactaccgagttcg

SEQ ID NO: 148737 - DNA, 674 bp, Homo sapiens
  misc_feature: GYAE6OF02ICQC9.35.41.D08.1.454.CMB.1.raw
  modified_base (311)..(311): a, c, t, g, unknown or other
  misc_feature (311)..(311): n is a, c, g, or t
  modified_base (552)..(552): a, c, t, g, unknown or other
  misc_feature (552)..(552): n is a, c, g, or t
  modified_base (659)..(659): a, c, t, g, unknown or other
  misc_feature (659)..(659): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccaaccactctgtctgtgtctccgaggggacagcgccaccctctcctgcgacgggccagtcaggtagtgtacgacagactaattcgccgttaggtaaccagacaaggtaaaggttggcctaggcctcccgaggcctcctntacttcgttttggtcggtcgtcccgtacgtcgggtccgtcgttggtcgtcccgtaaggtccgtaaggttccgaggtggccgtagtcgggctcgtagggtactaggtagttccacgttccgtaccgacctacgtctaagcctaccggtcccgtacgcgtaacgttccgtaaggtaacttacggttttctaccgtttaagttttactttacgttgtactacgaacgttattaaatacggtacncggttacgtccgttacgtcgtttacgtccgtttacggtttaccggaccgggttacgggtaccgtaaggtcgtacgggtctaaacgtaaccgaacgtacgtggtaacncgtacgtacctaacg

SEQ ID NO: 148738 - DNA, 676 bp, Homo sapiens
  misc_feature: GYAE6OF02HBNIT.35.41.D08.1.454.CMB.1.raw
  modified_base (213)..(213): a, c, t, g, unknown or other
  misc_feature (213)..(213): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccaagccacctgtctgtgtctccgaggggatagccatcctcncctgcagggccctagtcaggactacgttcggaacacgtagtctgggtaccagcaacggaacctcgggaccaggacctccccgaggtcctcctcaacttctacgtggtcgcactcccaccggacggcccaagtggtactccccgagacccgttagtccgagtggctacgggtcgggttcggtaggggacttaacggtacctttccgcctccttacgaaacccgtatttcccgaacgccgaccggtcctcggttaccgaacgttccgtacggtaaaggtaactttaacgtgtacgttaacgtttaacttctaacgttcgtcacgttaacgtacgtttaacgtacgtccgttcggacccgtcgtccttcgttacggtttccggcgggacggtaccggtacgggttcggacgtacgtaacgtaaaacgtgttacggtacggtacctacggtacctaactcgttacgg

SEQ ID NO: 148739 - DNA, 593 bp, Homo sapiens
  misc_feature: GYAE6OF02HRSKL.35.41.D08.1.454.CMB.1.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (384)..(384): a, c, t, g, unknown or other
  misc_feature (384)..(384): n is a, c, g, or t
  modified_base (588)..(588): a, c, t, g, unknown or other
  misc_feature (588)..(588): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaangccatccnctcctgcagggccagtcagagtatcggaactacgtagtctaggtaccagcaagaaacctgggaccaggcctcccaggcctcctcatccgtatggtncatccaccgnggccagtcggtactcccgagcctaggtcaggtgcgtagtcgggtctgggacaggtcttacacctcncgaccatccgagacacgtcctgccgtacgtgtagaagtattacgtagtacgttaagtttacaccgttacgttcgtacgtagtacttaagtttacgacgtccggtacggcccgtcgtcttcgtcgtttcgggcgggtacgggaccgtagggtacggacgtaacgtaacgtaaacgagttacggtcggtacgttcgaccttacgtnttccg

SEQ ID NO: 148740 - DNA, 740 bp, Homo sapiens
  misc_feature: GYAE6OF02I9J4T.35.41.D08.1.454.CMB.1.raw
  modified_base (204)..(204): a, c, t, g, unknown or other
  misc_feature (204)..(204): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaanagccatccctctcctgcacgggccagtcagagtattcggaacaacgtgtcgtcggtaccagcaagtaaccgtcggaccaggcctacccgaggtcctcctacacttctagtcgggtcacacctcccgaaccgcgggccctaacgttcggtaacctccccgaagtcccgttaagggttccaggtcggaccgtagggttcgggtaccgtaggggaactagggtaccctttcgaacctttcccaaccaccgtagtcccgaaggtccgtaaccggcttacggacccgtaggttctaaaggaacgttatttaacggtgtacccgttaagttttacctaccgtagttacgttaccaagggttaactttaaacggtttaagacccgggttcgttaccccgggtccccgttaccgggttcccgttccgttttaccgggttaccggggaccggggttacggggtaaacccgtaggggttaacggaacgttaacgaaacgtaaacggtacgtcgggtaacgttccgacgactacccgtagttacccg

SEQ ID NO: 148741 - DNA, 674 bp, Homo sapiens
  misc_feature: GYAE6OF02G5W5B.35.41.D08.1.454.CMB.1.raw
  modified_base (205)..(205): a, c, t, g, unknown or other
  misc_feature (205)..(205): n is a, c, g, or t
  modified_base (400)..(400): a, c, t, g, unknown or other
  misc_feature (400)..(400): n is a, c, g, or t
  modified_base (468)..(468): a, c, t, g, unknown or other
  misc_feature (468)..(468): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactgggagaaatagtgatgacgcagtctccagccaccctgtctgtgtctccgagggggaanagccatcctctcctgcgagggccagtcaggtagtacttacggaacaacggtatcgtggtaaccagcaacgaaaccgtggaccgacggcctcccgaggccttccctacattccgtttgggtcgttcgtaccgacgtcggggtccgtcgttgggtcctcccgaggtctagggttcaggtcggctaggtggcttcggngggtaactaggtacgtttcacgttactcaacctagtaccagcacgtctcgctagtcgtagtaacgttntttacgtacttaaggtttactttagtgttaaccgataaccttaaagttataagtaacgtccgttccggtaccgttaccggttaacggttcgttaccgtttaccggtttacggggaccgtaaacggggtaccgtaacgggtcgtaacggggtaactaacgtaaccgaacggttacgtcggtacggacccttgacctaccgtattccg

SEQ ID NO: 148742 - DNA, 837 bp, Homo sapiens
  misc_feature: GYAE6OF02GRA8T.35.41.D08.1.454.CMB.1.raw
tcagtacagatcgtcacgaccggtgctcgatttagtcacgcgagaaagggaaagggggaggaactgctcagttaggacccagacggaaccatggaagccccagcgcagcttctcttcctcctgctactctggcctccagataccactggagaaatagtgatgacgcagtctccagcctaccctgtctgtgtctaccgaggggaatacgccagtcctctcctgacgtacgggcctaggtccaaggagttaacgttaccgggaaaacctaacgggttacgtccttacggggtaaccaaggaccgtaacggtaaaacccttcgggacccctaacgggtacccgttacccccggaacggggtaccccctacccgttaccgtaacgttaccgtttaacggtcggggttacggtaccctaaccgttacccccgaacccggtaaccgggtccccctaaccggttacgggttaacccttacccccggaacggtccccggttaacgggttccgtaagggtttcggaccgtaggggttcggtacggtacgggacgtacgttaccttacgtaccgttccgacctaccgacttcgaacgtactcggtacctcgacgtacgttacgagttaaagttatacgtcgttagttaacgtttaccacgttacttacgtactaacggtactttaagttaaccgtaggtacccgtccggtcccgttacgttcccgttccgtttacggtccggggtacggtaccggaacggttacgggtacggtaaacgtaccgtaaaacgtaacggttacgtcgggttaaccggcgttaacccggtacgtaaccgttcgttaacccg

SEQ ID NO: 148743 - DNA, 690 bp, Homo sapiens
  misc_feature: GYAE6OF02I1MW8.35.41.D08.1.454.CMB.1.raw
  modified_base (203)..(203): a, c, t, g, unknown or other
  misc_feature (203)..(203): n is a, c, g, or t
  modified_base (628)..(628): a, c, t, g, unknown or other
  misc_feature (628)..(628): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaatagtgatgacgcagtctccagccaccctgtctgtgtctccgagggggaanacgccagtcctctcctgcgacggccagtcagtagtactacggaacacgtagtctaggtaccaggcaacgaacctggacctaggacctcccgaggccttccgtagacttactacgtgggtacacctcgtacccgaacgaccgggacctaccgtttaggacccgtacccgaggtaccccgtaggttacgacggttcgacgtagggtcgggttacgacgggtacgacgttcttccgaatttccgaccgaactcttaggaccgcgacgtccgtacgtacgtacgtacgtacgtaagtacttagacctgttaacgtttactacgtaccgtgtacacgtaattagttacacgtccgtaccggtcccgttaacgccgtttcgttacggtaccgggaccggtacgtaaccggttacgggtacgtaaaccggtntaaacccgggtaaagtaccgttacggtacgtaaccgtcggtaccgttaccgtagtttcccgg

SEQ ID NO: 148744 - DNA, 733 bp, Homo sapiens
  misc_feature: GYAE6OF02JL1J5.35.41.D08.1.454.CMB.1.raw
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtcctccaaccactctgtctgtgtcctcgaggggacagacgccctaccctctccgtgcgacgggccagtcgagagttgtacgcagactaacttacgccgtcgtaccagacgaaggtaaacggttcggccgacggtccctacccgaggtcctcctacgtatttcggtttggtcgttaccgtcccgtacggtaccggggccgtacgttcgggtcccgtcccgtaagtcgtacgggttacgtacggtcggacgtagtcggtcgttcgggtacgggactaggttaccttactaccgtcctaaccgacctcgtacgacgtcgtaccgtcgtacgaccgtcgtacgtacggtaagttcgtttacggtcctttaagttttacttaacgttcggtactaacgaacttaaagttaacgtacgttaaggtccgtacgtcccgttacggttaacgttcgtaacgtttccgggttacggcccgggtaacggggtaacacggttacggttaggaaccgttaaccggtaaaccgtaacggtttcggacgggttaccggtacgttaccgaccgtttaaccg

SEQ ID NO: 148745 - DNA, 669 bp, Homo sapiens
  misc_feature: GYAE6OF02GX54C.35.41.D08.1.454.CMB.1.raw
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
  modified_base (346)..(346): a, c, t, g, unknown or other
  misc_feature (346)..(346): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggctcccagataccactggagaaatagtgatgacgcagtctccagccaccctgtcngtgtctccagggggaanagccatcctctcctgcgagggccagtcagtagtattcggaacaacgtagtctaggtaccagcaacgaacctggaccaggcctcccgaggtcctcctctaatctagtggtcgctactccaaccgacgggcctaacgtggtaccncccgacggtcctaacgggttcagtcggcagggttcgggtctaggggactacggactttacaccgttcgtaccaaccgtactacgacgcacgtcctacgccgttagtctaagtaagtacttacgtacgtacttacggtttactccgtaacgttcgttacgtacgtacttaacgtttaagtacgtaccgttccgggcccgtccgttaccgttccgttccgggtttccggggacgggtaccgggtaccggtaacgggtcggtaaacggtactaacggtaaacgtagttacggtacggtaccgtaccggaccgttacgtattaccgg

SEQ ID NO: 148746 - DNA, 738 bp, Homo sapiens
  misc_feature: GYAE6OF02FPXTR.35.41.D08.1.454.CMB.1.raw
  modified_base (207)..(207): a, c, t, g, unknown or other
  misc_feature (207)..(207): n is a, c, g, or t
tcagtacagatcgtcacgaccggtgctcgatttagtcacgcgagaaagggaaagggggaggaactgctcagttaggacccagacggaaccatggaagccccagcgcagcttctcttcctcctgctactctggcctccagactaccactggagaaagtagtgagtcgacgcagtctccacgccacctgtctgtgtctcggaggggaancgcactctcctctgcgacggccagtcgagtagttacgtacggaacacgtacgtctacggtacaacgaacgaaccgtcggaccacggccgtacccgacggtcctacctactacttacgtacggtggtcgctaccgtacccgaccgaacgggtcctaggttacggtacctcccgacgtaccggtacggttactaggtcgggactacgggtcggggtacgtacgggactacggtctccgactaccgtcaacctactaccgactacgaccgtcctacggtctacggttacggtaagaacgtttactacggtacgttacgttaacgtttacaccttacgttcggtactaggttaccgttaagtttaccggtacgtcccggttaccggtccgttaccggttctttaccggttacgggttaccgggaccggggtaccgggtaccgggtaagggtaggtaacggtaacggttaaacggaaaccggtaccggttaggtaccggttaccgaccggtaacccgtacggtcgttaccttacgg

SEQ ID NO: 148747 - DNA, 140 bp, Homo sapiens
  misc_feature: GYAE6OF02GLPAP.35.41.D08.1.454.CMB.1.raw
  modified_base (128)..(140): a, c, t, g, unknown or other
  misc_feature (128)..(140): n is a, c, g, or t
tcagtacagatcgtcacgaccggtgctcgatttagtcacgcgagaaagggaaaggggaggaactgctcagttaggacccagacggaaccatggaagccccagcgcagcttctcttcctcctgctaccnnnnnnnnnnnnn

SEQ ID NO: 148748 - DNA, 529 bp, Homo sapiens
  misc_feature: GYAE6OF01DOO6Q.15.34.D01.1.454.CMB.1.raw
  modified_base (501)..(501): a, c, t, g, unknown or other
  misc_feature (501)..(501): n is a, c, g, or t
  modified_base (523)..(523): a, c, t, g, unknown or other
  misc_feature (523)..(523): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgttcctttatgtggggcgtggctagttttgggtgtttcgggcggagggaccaaacgtgaccgtcctaggtcagcccaggctcgcccctggtcactctgttcccnccctcctcgctacgtagactgngcgggc

SEQ ID NO: 148749 - DNA, 525 bp, Homo sapiens
  misc_feature: GYAE6OF01CPX23.15.34.D01.1.454.CMB.1.raw
  modified_base (497)..(497): a, c, t, g, unknown or other
  misc_feature (497)..(497): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctgctccatccttgggaacaaagctgccctcaccatcacggggcccaggcagacgatgaatgtgattatcactgcgttcctttatgtgggcgtggctagtttgggtgttcggcggagggaccaaacgtgaccgtcctaggtcagcccaggctcgcccctcggtcactctcgttcccnccctcctcgctacgtanactgngcggcg

SEQ ID NO: 148750 - DNA, 458 bp, Homo sapiens
  misc_feature: GYAE6OF01BEL43.15.34.D01.1.454.CMB.1.raw
  modified_base (447)..(447): a, c, t, g, unknown or other
  misc_feature (447)..(447): n is a, c, g, or t
  modified_base (453)..(458): a, c, t, g, unknown or other
  misc_feature (453)..(458): n is a, c, g, or t
tcagtctacgtagccacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattacgtggacaggacccttggtcttccggcgagcgggtcttttcacccgtctttatcgttacttatgtcatcctttcccgccctctcgctacgtagactgagcgggctggcaaggcncatagnnnnnn

SEQ ID NO: 148751 - DNA, 370 bp, Homo sapiens
  misc_feature: GYAE6OF01ATM91.15.34.D01.1.454.CMB.1.raw
  modified_base (364)..(370): a, c, t, g, unknown or other
  misc_feature (364)..(370): n is a, c, g, or t
tcagtctacgtagccacgaccggtgctcgatttagatcgtctgtgttgggtttgggcagggagtgggctaaggtgaggcaggtggcaccagccaggtgcacacccaatgcccgtgagcccagacactggaccctgcctggaccctcgtggatagacaagaaccgaggggcctctgcgccctgggcccagctctgtcccacaccgcggtcacatggcaccacctctcttgcagcctccaccaagggcccatcggtcttcccctggcgccctgctccaggagcacctccgagagcacagcggccctgggctgcctggtcaaggctacttccgctacgtagactgagcggctggcaaggcgcatagnnnnnnn

SEQ ID NO: 148752 - DNA, 528 bp, Homo sapiens
  misc_feature: GYAE6OF01DFXE0.15.34.D01.1.454.CMB.1.raw
  modified_base (521)..(521): a, c, t, g, unknown or other
  misc_feature (521)..(521): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctgctccatccttgggaacaagctgccctcaccatcacggggccaggcagacgatgaatgtgattatcactgcgttcctttagtgtgggcgtggctagtttgggtgttcggcggagggaccaaacgtgaccgtcctaggtcacgcccaggctcgcccctcggtcacgtctgttccccgccctcctcgctacgtagactgngcgggtc

SEQ ID NO: 148753 - DNA, 551 bp, Homo sapiens
  misc_feature: GYAE6OF01EHIEA.15.34.D01.1.454.CMB.1.raw
  modified_base (544)..(544): a, c, t, g, unknown or other
  misc_feature (544)..(544): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtacccggcacgaccccaggccagcctccacgcacgctcatctacagtacaaacactcgctcttccggggtccctgactcgcttctctggctccatccttgggaacaagctcgcccctcaccatccgaccgggggccccaggccagacgatgaatgtgattatcactgcgttcctttagtggtggggcgtggcttagtttggggtgttcgggcgggagggaaccaaacgttcgaccgtccgtaggtcnggacccg

SEQ ID NO: 148754 - DNA, 533 bp, Homo sapiens
  misc_feature: GYAE6OF01BU2PR.15.34.D01.1.454.CMB.1.raw
  modified_base (526)..(526): a, c, t, g, unknown or other
  misc_feature (526)..(526): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggccagcctccacgcacgctcatctacagtacaaacactcgctcttccggggtccctgatcgcttctctggctccatccttgggaacaaagctgccctcaccatcgacgggggcccaggcagacgatgaatgtgattatcactgcgttcctttatgtggggcgtggctagtttgggtgttcggcggagggaccaaacgtgaccgtcgtaggtcacgcccaaggctcgcccctcgtccactctcgtcccgccctccctcgctacgagactgngcgggcg

SEQ ID NO: 148755 - DNA, 530 bp, Homo sapiens
  misc_feature: GYAE6OF01A9SSG.15.34.D01.1.454.CMB.1.raw
  modified_base (525)..(525): a, c, t, g, unknown or other
  misc_feature (525)..(525): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttctggggtccctgatcgcttctctggctccatccttgggaacaaagctgccctcaccatcgacgggggcccaggcagacgatgaatgtgattatcactgcgttcctttatggtggggcgtggctagtttgggtgttcggcggagggaccaacgtgaccgtcctaggtcagcccaaggctcgcccctcggtcactctcgttccccaccctcctcgctacgtagctgngcggg

SEQ ID NO: 148756 - DNA, 549 bp, Homo sapiens
  misc_feature: GYAE6OF01AUYGJ.15.34.D01.1.454.CMB.1.raw
  modified_base (510)..(510): a, c, t, g, unknown or other
  misc_feature (510)..(510): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccggggtccctgatcgcttctctggctccatccttgggaacaagctgccctcaccatcgacggggcccaggcagacgatgaatgtgattatcactgcgttcctttagtggtgggcgtggcgtagtttgggtgttcggcgggagggaccaaacgtgaccgtcgtaggtcacgcccaggcctcgcccctcggtccacgtcctcgttccccnccccttcccgtccgcctacgtacgactgcggcgggtacg

SEQ ID NO: 148757 - DNA, 543 bp, Homo sapiens
  misc_feature: GYAE6OF01B10GX.15.34.D01.1.454.CMB.1.raw
  modified_base (536)..(536): a, c, t, g, unknown or other
  misc_feature (536)..(536): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcagaccccaggccagcctccacgcacgctcatctacagtacaaacactcgctcttccggggtccctgatcgcttctctggctccatccttggaacaagctgcccctcaccatccgaccgggggcccagggcagacgatgaatgtagattatctactgccgttcctttatggtggggtcgtggcgtagtttgggtggttcgggcgggacggaccaacgtcgaccgtcctaggtcnggacccg

SEQ ID NO: 148758 - DNA, 568 bp, Homo sapiens
  misc_feature: GYAE6OF01DKH1V.15.34.D01.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
tcagtctacgtagccacgaccggtgctcgatttagatcgtctgtgttgggtttgggggaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgctggtaccggcacgacccnggccagcctccacgcacgctcatctacagtacaaacactcgctcgttccgggtccctgactcgcttcnctgctcatctggacaagctcgccctcacnctcgacggggccaggcagacgatgaattgtanattactctactcgtcgtttcctttagtcggttacgggtcgtcggtcgttagttttcggggtaggtttccggcggggtaacgggaaccctaaacgtcgtaacccggtccttacgggtcgcggtaaccccg

SEQ ID NO: 148759 - DNA, 565 bp, Homo sapiens
  misc_feature: GYAE6OF01AYRYN.15.34.D01.1.454.CMB.1.raw
tcagtctacgtagccacgaccggtgctcgatttagatcgtctgtggtggaatctgggggaggcttggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtggcgggaggccggagtggtatttggattctttcgtggggccaggggccctggtccaccgtctcctcgagccctaccaccgaacgggccccagtccggttccttcccccgtggccgcccctgcctccgaggtacgccaccctccggagacgcacgacggccggccctgggcctcgcccgtggtcaaggccttaccgtccgcgttacgtagactggacggcgggctgggacaaggccgcgagtacg

SEQ ID NO: 148760 - DNA, 613 bp, Homo sapiens
  misc_feature: GYAE6OF01D3A7O.15.34.D01.1.454.CMB.1.raw
  modified_base (351)..(351): a, c, t, g, unknown or other
  misc_feature (351)..(351): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctccgttccggggtccctgactcgcttctctggctccatccgttagggaacaagctcgcccctcaccatccgaccggggcccaggcagacgatgaatgtgtattactctacgtcgtccgttcctttagtgggttcggggtcggtcggtacgttaggttttgggggttcgggtttccggggtaccgggaacggggtaacccgaaaaccggttccggtaaccccggttacccggttaacgggtccgacggtaaccccggg

SEQ ID NO: 148761 - DNA, 573 bp, Homo sapiens
  misc_feature: GYAE6OF01CH6NT.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgaccccaggagccatcgttctcagtgtcccctggagggacagtcacactcacttgtgccttgaggtctggctcagtctctacttctaactacgccgcctggtaccggcagaccccaggccagccctccacgcacgctcatctacagtacaaacactcgctcttccgggtccctgactcgcttctctgctccatccttgggaacaagctgccctcaccatccgacggggcccaggcagacgatgaatgtgattatcactgtcgttcctttagtggtgggcgtggctagtttgggtgttcgggcggacgggacctaaacgtcggacccgtccgtaggtccacgacccgaaggcctccgcccctcgggtccaccgttccgttccgttcccccgccctcccgtccgccttaccgtacgtaccgtggacggcgggtccg

SEQ ID NO: 148762 - DNA, 621 bp, Homo sapiens
  misc_feature: GYAE6OF01DFUM8.15.34.D01.1.454.CMB.1.raw
  modified_base (397)..(397): a, c, t, g, unknown or other
  misc_feature (397)..(397): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgcctgagtctggctcagtctctacttctaactacgccgcctcggtaccggcacgaccccaggccacgccctccacgccacgctcatcctacacgtaacaacactcgctccgttccggggtccctgactcgcttctcgtgctcctntccgtaggaacaagctcgccctcacctacgccggaccggggcccacggcgacgacgatagatgtagtattactctacgtcgtacgtttcgtttagttgggtcgggtcggtcggtacgttacgggttttcggggttcgggtttcggggaccggggtaccggggtaaacccgtaaaccggtacggtaacccggttccggttaacgggtcccgaacggtaaccccgg

SEQ ID NO: 148763 - DNA, 622 bp, Homo sapiens
  misc_feature: GYAE6OF01BPOLH.15.34.D01.1.454.CMB.1.raw
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctccgttccgggtcctgatcgcttctctcgctcattccgttaggaacaagctcnccctacaccatccgacggggccaggcagacgntagaatgtagattactcacgttgtccgttactttagtggtcggggtcgtcggtcgtaggttttgggtcggttcgggtacggaacgggtaccaaacgtcgtacccggtcgttacggtacgacgtacccgacggtcctccggtcccccgttcggtaccgtaccgtccgttacccgttaccccctaccccgttcccgttccgtaccgttaaccggtacgtacctcgggacggtccgggtacgg

SEQ ID NO: 148764 - DNA, 557 bp, Homo sapiens
  misc_feature: GYAE6OF01B0ODK.15.34.D01.1.454.CMB.1.raw
  modified_base (347)..(347): a, c, t, g, unknown or other
  misc_feature (347)..(347): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccgcacgaccccaggccagcctccacgcacgctcatctacagtacaacnctcgctccgttccgggtccctgactcgcttctcgtcgctcctatccgttagggaaacaagctcgcccctcaccagtccgaccggggcccaggcagacgatgaagtgtgtattactctactgtcgttcctttagtcggtggggtcgtggtcttaggtttgggtgttcgggcggacgggaccaacgtcgaccgtacctggtcgacgtacccg

SEQ ID NO: 148765 - DNA, 567 bp, Homo sapiens
  misc_feature: GYAE6OF01ENZDA.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcgacggggcccaggcagacgatgaatgtagattatcactgcgttcctttagtggtgggcgtggctagtttgggtgttcggcggagggacaaacgtcgaccgtccgtaggtcacgcccgaggcctcgcccccgtcggtcctaccgtccgttcgttcccccgccccttcccgtccgccttaccggtacgtaccgtcggacgcggggtaccg

SEQ ID NO: 148766 - DNA, 546 bp, Homo sapiens
  misc_feature: GYAE6OF01BYFR6.15.34.D01.1.454.CMB.1.raw
  modified_base (375)..(375): a, c, t, g, unknown or other
  misc_feature (375)..(375): n is a, c, g, or t
  modified_base (538)..(538): a, c, t, g, unknown or other
  misc_feature (538)..(538): n is a, c, g, or t
tcagtctacgtagccacgaccggtgctcgatttagatcgtctgtgttgggtttgggggaaaaggtcctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgcttgagtctggctcagtctactactctaactacgccgcctggtaccgcacgaccccaggccagccctccacgcacgctcatctacagtacaacactcgctcgtccgggtcctgactcgcttcnctgctccatccgttggaacaagctcgccctacaccatccgaccggggccaggcagacgatagtaatgtagtattactctacgtcgtcgttccgtttagtcggtgggtcgtggtcttagtttgggtggttcggcggacggacaacgtcgaccgtcgtacggtcncgtacccg

SEQ ID NO: 148767 - DNA, 535 bp, Homo sapiens
  misc_feature: GYAE6OF01D7R2R.15.34.D01.1.454.CMB.1.raw
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
  modified_base (525)..(525): a, c, t, g, unknown or other
  misc_feature (525)..(525): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgcctccacgcacgctcatcacagtacaaacactcgctcttccggggtccctgatcgcttctctgctccatccttgggaacaagctgccctcaccatcgaccggggcccaggcagacgatgaatgtgattancactgcttcttatggtgggcgtgctgtttgggtgttcggcggagggaaccaacgtcgtaccgtcgtgtacncgccgagcncgcccctcgtccnctcgtcttccccgccctcccgtcgcctacgtacagtcgnggcgggtcgg

SEQ ID NO: 148768 - DNA, 555 bp, Homo sapiens
  misc_feature: GYAE6OF01EFKS4.15.34.D01.1.454.CMB.1.raw
  modified_base (354)..(354): a, c, t, g, unknown or other
  misc_feature (354)..(354): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccacgccctccacgcacgctcactctacagtacaaacnctcgctcgttccgggtccctgactcgcttctctgctcatcctggaacaagctcgcccctcaccagtccgaccggggcccaggcagacgatgaatgtgattatctactgtcgttcctttagtcggtgggcgttggtctaggtttcgggtggttcggcgggacgggaccaaacgtcgacccgtacgtacggtccaggtacccg

SEQ ID NO: 148769 - DNA, 538 bp, Homo sapiens
  misc_feature: GYAE6OF01CATJ8.15.34.D01.1.454.CMB.1.raw
  modified_base (530)..(530): a, c, t, g, unknown or other
  misc_feature (530)..(530): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaagctgccctcaccatcgacggggcccaggcagacgatgaatgtagattatcactgccgttcctttagtggtgggcgtggctagtttgggtgttcgggcggagggaccaacgtcgaccgtcgtaggtcacgcccaggcctcgcccctcggtcacctctcgtcccgccctcctcgctacgtacgactcgnggcggtcg

SEQ ID NO: 148770 - DNA, 568 bp, Homo sapiens
  misc_feature: GYAE6OF01AEZ9A.15.34.D01.1.454.CMB.1.raw
  modified_base (390)..(390): a, c, t, g, unknown or other
  misc_feature (390)..(390): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcgtcggtaccggcacgaccccaggccacgcctccacgcacgctcactctacagtacaaacactcgctcgtccgggtccctgactcgctctctgctcntcctaggacaagctcgccctcaccagtccgaccggggaccaggcgagacgatgaatgtgtattactctacgtgtcgttcgtttagtcggtgggcgtggcgttaggtttgggttcggttcgggcgggtaacgggaacctaaccgtcgtacccggttccgtacggtccgacggtaccccg

SEQ ID NO: 148771 - DNA, 563 bp, Homo sapiens
  misc_feature: GYAE6OF01BLGUY.15.34.D01.1.454.CMB.1.raw
  modified_base (448)..(448): a, c, t, g, unknown or other
  misc_feature (448)..(448): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtccctggagggacagtcacactcacttgtgccttgaggtctggctcagtctctacttctaactacgccgctggtaccggcacggaccccaggccacgcctccacgcacgctcatctaacagtacaaacactcgctcgtccggggtcctgactcgcttctctggctccatcctaggaacaagctcgccctcaccatccgacggggcccaggcacgacgatcgaatgngtattactcatcgtcgttctttagtggtcggggtgtcggtcgttaggtttgggtcggttcgggcgggtagggtaccctaaacgtcggtaaccgttccgtaggtccgcgaaccccg

SEQ ID NO: 148772 - DNA, 559 bp, Homo sapiens
  misc_feature: GYAE6OF01BEMGF.15.34.D01.1.454.CMB.1.raw
  modified_base (351)..(351): a, c, t, g, unknown or other
  misc_feature (351)..(351): n is a, c, g, or t
  modified_base (432)..(432): a, c, t, g, unknown or other
  misc_feature (432)..(432): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacnctcgctccgttccgggtccctgactcgcttctcgtgctccatcctaggaacaagctcgccctcaccatccgacggggcccnggcacgacgatgaatgtagtattactctactgtcgttctttagtggtgggtcgtggctaggtttcgggttggttcgggcgggtacggaccgaacgtcgtacccgtacgtacggtccgacgtacccgg

SEQ ID NO: 148773 - DNA, 542 bp, Homo sapiens
  misc_feature: GYAE6OF01D942R.15.34.D01.1.454.CMB.1.raw
  modified_base (388)..(388): a, c, t, g, unknown or other
  misc_feature (388)..(388): n is a, c, g, or t
  modified_base (508)..(508): a, c, t, g, unknown or other
  misc_feature (508)..(508): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctctacgcacgctcatctacagtacaaacactcgctcttccggggtcctgatcgcttctctgctcatccttggaacaagctgccctcaccatcgacggggcccaggcagacgatgaatgtgattancactgtcttctttatggtgggcgtggctagtttgggtcgttcgggcggacgggaccaacgtggacccgtcgtaggtcacggacccaggcctccgccccctggtccacgtctcgttccccnccctccgtcgcctacgtacgatcggcgcgggtcg

SEQ ID NO: 148774 - DNA, 620 bp, Homo sapiens
  misc_feature: GYAE6OF01CCJOX.15.34.D01.1.454.CMB.1.raw
  modified_base (381)..(381): a, c, t, g, unknown or other
  misc_feature (381)..(381): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccgggtccctgatcgcttcnctggctcatcctaggaacaagctgccctcaccatccgacgggggcccaggcacgaccgagtgtaatgttagatttacgtcctacgttcgtccgtttccgtttaagtcgggttcgggggtcggttcgggtacgttaggttttcgggggttcggtttccggggtaccggggaacggggtaacccgtaaaccggttacggacccggtttacccgtacgggttacccgacggtaacccccggg

SEQ ID NO: 148775 - DNA, 623 bp, Homo sapiens
  misc_feature: GYAE6OF01C70CT.15.34.D01.1.454.CMB.1.raw
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagtctacgtagccacgaccggtgctcgatttagatcgtctgtgttgggtttggggcagggagtgggctaaggtgaggcaggtggcgccagccaggtgcacacccaatgcccgtgagcccagacactggaccctgcctggaccctcgtggatagacaagaccgagggcctctgcgcccgtggcccagctctagtcccacaccgcggtcacatcggcaccacctctcttgcagccctaccaccgaacgggccctatcccggttccttcccccgtgccgtccctgcctcgaggactccaccgtcgagacgcacgaggtccggccgtcgggctcgtccgtggtaccgaaacgggtaccttaccggtttcccgacgttaaccgtaacggacgttaggaccgggtaccgggtcgttaccgggacgtaaccgggcgtaacgtacgttacggctcgacncgtnaagccgtgcttaccgngtancgactgagtcgatcgtcgcgacgtacgacgtcgtacgtacgacgtcgtcgtacgtcgtacgtacgcgtacgtcgtcgtacgtcgtacgtacgtacgtcgtacgcgtacgtcgtacgtctacgtacgtacgacgtcgtcgtcgtacg

SEQ ID NO: 148776 - DNA, 613 bp, Homo sapiens
  misc_feature: GYAE6OF01B1HV0.15.34.D01.1.454.CMB.1.raw
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttggaggtctggctcagtctctacttctaactacgccgcctggtaccggcacgaccccaggccagcctccacgcacgctcatctacagtacaaacactcgctcgttccgggtaccctgactcgcttcnctggctccattccgtagggaaacaaacgcctaccnccacactcgaccgggccaggcacgacgangtatgtagtatatcactcgtcttccttagtggtcgggtcggtgcgttagtttggggttggtaccgggtcgggaacgggaaccctaaacgtccggtaaccggtcccgtaggtaccgaccgtcccgaacgccgtacccgccccggtccggtctaccctaccgttccttccccctaccccgtccttccgacccgttacgtacgacgtggacggcgggtcgtacggg

SEQ ID NO: 148777 - DNA, 638 bp, Homo sapiens
  misc_feature: GYAE6OF01AN1FM.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctcggtaccggcacgaccccaggccacgcctccacgccaccgcctcactactacagtaacaaaccactccgccttccgttcccgggtcccgtcgactccgtcttctcgtcgtcctcctactccgttacggaacaaacgctcgccctaccacccacgtaccggaccggggacccgttttacggacgacgaacgagtagtaagtgtagtattactactacgtcgtcgttcgtttagtggtgggtcggtggtcgttaggtttgggttcggtcgggacgggacggaaccgtaacgtacgtaccgtcgtacgtcgacgaccgacgccgtccgtccccgtccgtcctccgtccgttccgttcccgtccctcccgtccgtaccgtacgtacgacgtcggcggcggtcgg

SEQ ID NO: 148778 - DNA, 620 bp, Homo sapiens
  misc_feature: GYAE6OF01BDDGR.15.34.D01.1.454.CMB.1.raw
  modified_base (323)..(323): a, c, t, g, unknown or other
  misc_feature (323)..(323): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtacaaacactcgctccgttccgggtccctgactcgcttcnctgctccatccgtaggaacaagctcgccctcaccagtccgacggggcccaggcagacgatacggtaatgtagtattactcacgtgtccgtttaccgtttagtgggtcgggtacgtgggtacttaggtttcggggtcggttcgggacgggaacgggtaacctaaacgtcggtaccgtccgtacggtaccacgcccgaaggtcctaccgtccccgtcggtacctaccgttccgtccgttaccccctcccttcccgtacgtaccgttacggtaacgacgtacgggtcggccgggtacggg

SEQ ID NO: 148779 - DNA, 677 bp, Homo sapiens
  misc_feature: GYAE6OF01B1DV3.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttactaactacgccgcctggtaccggcacgaccccaggccagccctccacgcacgctcatcctacagtaacaaacactcgcttccgttccggggtccctgactcgtcttcgtcgtcgtcctacgtacttaccgtacggaaacacgtctccgccctacgaccacgtacccgggacccgggacccgacggccaacggaccgtagtacgtacgttaggtagtaattacgtaccgtacgttcgttaccgtttacgtttaggtacggggtcggggttcggtaggttccggtttaggggtttcggggtttacggggttccggggacggggtaaaccgggtaacccgttaaaccgggtccggtaacccggttaaccggtacggtacccgaaccggtaaccccggg

SEQ ID NO: 148780 - DNA, 615 bp, Homo sapiens
  misc_feature: GYAE6OF01BXB36.15.34.D01.1.454.CMB.1.raw
  modified_base (323)..(323): a, c, t, g, unknown or other
  misc_feature (323)..(323): n is a, c, g, or t
  modified_base (398)..(398): a, c, t, g, unknown or other
  misc_feature (398)..(398): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagccctccacgcacgctcatctacagtacaaacactcgctcgttccgggtcctgactcgcttcncgtgctcatcgtaggaacaagctcgccctcaccagtccggacggggccaggccagacgatacgaatgtatattanacctacgtcgtcgttactttaggtcgggtcgggtcgtggtcgttaggttttgggtcggttaccgggacggaacgggtaacctaacgtcggtacccgttacgtacggtcgaccgtaccgtacgtccgtccgtccccgttcggacctaccgtcccgttcgttaccccctacccgttcctacgtcccgttaacgtacgtaccgcggtcgggcggtaccgg

SEQ ID NO: 148781 - DNA, 558 bp, Homo sapiens
  misc_feature: GYAE6OF01CZ8TH.15.34.D01.1.454.CMB.1.raw
  modified_base (390)..(390): a, c, t, g, unknown or other
  misc_feature (390)..(390): n is a, c, g, or t
  modified_base (502)..(502): a, c, t, g, unknown or other
  misc_feature (502)..(502): n is a, c, g, or t
  modified_base (547)..(547): a, c, t, g, unknown or other
  misc_feature (547)..(547): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggatttctcagactgtggtgacccaggagccatcgttctcagtgtcccctggagggacagtcacactcactttgtgccttgaggtctggctcagtctctacttctaactacgccgcctggtaccggcacgaccccaggccagcctccacgcacgctcatctacagtacaacactcgctcttccgggtccctgatcgcttctctgctccatccttggaacaaagctgccctcaccatcgacggggcccaggcagacgatgaatgtgattntacactagcgttcctttatggtcgggtcgtggctagtttgggttgttcgggcggtagggacctaaacgtcgaccgtcgtaggtcacgacccgaggcctcgcccctcggtccncgttcgtcgttccccgcccttccctccgtcctacgtacgagtcgnggcgggtccgg

SEQ ID NO: 148782 - DNA, 759 bp, Homo sapiens
  misc_feature: GYAE6OF01CHKPK.15.34.D01.1.454.CMB.1.raw
  modified_base (508)..(508): a, c, t, g, unknown or other
  misc_feature (508)..(508): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgtcctggtaccgcacgaccccaggccagccctccacgcacgctcatctacagtaccaaacactcgctacgttccgggtccctgactcgcttcctcgtgcctccactccgttagggaactaaacgtcctcgtccctacgaccctacgtacccgggaccgggggcccaaggggccaaacggacgtaagtacggtaaacttggtagtaacttactacctaaccgttcgttacccgtttaccgttttgggtacgggttcgggggccgtttacggggtntttacggggtttttggggtacggtttccggggtacgggaacccgggtaacctaaaccggtcgggtaaccccgttaccggtaacgggttacccgacggaccccgtaacggtcccgtacccggtcccccgttccgggtacccttaacccggttcccgttacccgttaccccccgtaccccttccccggttacccggtaacccgttaccggtaaccggttacccgtagggtcccgggtccggggttaacccggg

SEQ ID NO: 148783 - DNA, 602 bp, Homo sapiens
  misc_feature: GYAE6OF01BNFZ1.15.34.D01.1.454.CMB.1.raw
  modified_base (325)..(325): a, c, t, g, unknown or other
  misc_feature (325)..(325): n is a, c, g, or t
  modified_base (380)..(380): a, c, t, g, unknown or other
  misc_feature (380)..(380): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcactttgtgccttgaggtctggctcagtctctacttctaactacgccgcctggtaccgcacgaccccaggccagccctccacgccacgctcatctacagtacaaacactcgcttctccgggtccctgactcgcttctntggctcatccgttggaacaagctgccctcaccatcgacgggtcccaggcagacgntagaatgtagattactctcgtgtccgtctttatggtgggcgtggtcgtagtttgggngttcgggnggacgggaccaacgtcggtaccgtcgtacgggtcacgccccgaaggtccctccggtcccccgtacggttctaacccgttccgttccggttacccccgtaccccttccgtaccgttaccgttaccgtaccggacgtacggtacgggcggttacccggg

SEQ ID NO: 148784 - DNA, 780 bp, Homo sapiens
  misc_feature: GYAE6OF01DCL4R.15.34.D01.1.454.CMB.1.raw
  modified_base (255)..(255): a, c, t, g, unknown or other
  misc_feature (255)..(255): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccgcacgacccgnggccagcctccacgcacgctcatctacacgtaacaaacactcgtactccgttccgggtccctgactcgctttcgtcgtggtcctcctacgtaccgttacgggaaacaaacgcttaccgccccttacaccgtacgtacccggaccgggggcccaacggaccgaacggacgtaacgtaggaaacttgggtaacgtaacgtttacgtaccgttaacgttccggtaccccggtttttaccgttttaacggtttacgggggttcgggggttccgggttacgggttacccgtttaggggtttttacgggggtttcgggttaccgggggtaaccggggtaaccggggtaaacccgtaaaccggttaccggtaaccccggtttaccggtacgggtaccgaacccggtacccggaacgggttcccgtaccccggtcccccggttaccggttcctaacccgtttcccgttcccgttacccccgtaccccgttccgtaccgtcgtaaccgtacgcgtacggccgggtcggtaccgg

SEQ ID NO: 148785 - DNA, 733 bp, Homo sapiens
  misc_feature: GYAE6OF01CSAQJ.15.34.D01.1.454.CMB.1.raw
  modified_base (128)..(128): a, c, t, g, unknown or other
  misc_feature (128)..(128): n is a, c, g, or t
  modified_base (349)..(349): a, c, t, g, unknown or other
  misc_feature (349)..(349): n is a, c, g, or t
  modified_base (463)..(463): a, c, t, g, unknown or other
  misc_feature (463)..(463): n is a, c, g, or t
  modified_base (511)..(511): a, c, t, g, unknown or other
  misc_feature (511)..(511): n is a, c, g, or t
tcagtctacgtagccacgaccggtgctcgatttagatcgtctgtgttgggtttgggaacctatgaacattctgtagggccactgtcttctcctcggactccttgcttatggatcaggagtggatttcncagactggtggtgacccaggagccattcgttctcagtcgtccccgtggaggacagtcacactctacttgtcgccttgaggtctggctcgatctctacttctaactacgccgcctcggtaccggcacgacccgaggccagccctccacgcgactcctcactactacgaactaaccaaactcgtcctccgtttccggttcccgggcctagtctccgtctttcncgtcgtccctataccgttacgtaaccggaactaacgtcctaccgtccctaacaaccgttacggaccccgggaccgggaccctaggacgtaaggacctaagtacgtagtacggtnttaacgttactaaccgtcgttaccggtttacgtttacggtttacgggnggggtttacgggcgttgggttacggtttggggttacgggttccgggttcgggacggtaaacggtaaccgtaaacgtcccgggtaccgtacgtcggtaccgaccgccgtaacggtccctcccgtccgtacccgtcgtacccgtttcccggtaacccgttccccgtcccgttcccgtaaccgttccgttaccggtacgccgggttacgcgggcccgggtacggg

SEQ ID NO: 148786 - DNA, 582 bp, Homo sapiens
  misc_feature: GYAE6OF01EHKSF.15.34.D01.1.454.CMB.1.raw
  modified_base (565)..(565): a, c, t, g, unknown or other
  misc_feature (565)..(565): n is a, c, g, or t
  modified_base (575)..(575): a, c, t, g, unknown or other
  misc_feature (575)..(575): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgtccttgaggtctggctcagtctctacttctaactacgccgcctcggtaccgcacgaccccaggccacgcctccacgccacgctcatctacagtacaacactcgcttcgtccgggtcctgactcgtcttctcgtgctccacttccgtaggaacaagctcgccctacgaccagtcgaccggggccaggacacgacgagtacgtaagtgtagtattactctacgttcgtccgttcgttagtgggtcgggtcgtggtctgtttgggtcggtcggacggacgtaccaacgtcgaccgtcgtacggtcacgtaccacgtccgtccgcccgtcgtctaccgtcgttccgtccccgtcctccgtcgactacggtacncgtcgtcggnggtacgg

SEQ ID NO: 148787 - DNA, 789 bp, Homo sapiens
  misc_feature: GYAE6OF01E4CTP.15.34.D01.1.454.CMB.1.raw
tcagtctacgtagccacgaccggtgctcgatttagatcgtctgtggtggaatctgggggaggcttggtccagcctggggggtccctgagactctcctgtgcagcctctggattcagttctagtaaatactggataagttgggtccgccaggctccaggggaaggggctggagtggatggccaatatgaaaccaagacggaagtgaataaacatcatgtgggctctgtgcgagggccgattcactatctccagagacaacgccaagaatctagttgtatttgacaaatagaacacgcctgaagacgccgaacgaacgaccggtcttggttagttaatttacgtggtcgggccggggaggggccgggtaggttgggttagttttacgggtaatttaccgttttcggggtaccgggggacccggtaacgggggtaccccttggggtccctaccccggttccttaccctccgaccgtcccccgttaccccgaaccggaaccggggtcccctaacgtttccccgggttacccctttccccccggtcgggccccgtcccgtcggccctaccggacggtaaccgccctacccgtccgacggaccgaccgaaccgtacgggaccccggtcccggtacgggttccgtcggtacccgtttacggggtaacccgaaacggggttacccgttaacccggtcccccggtaaccgttaaccgggtaaccgtaacccgggttgggaaccggggtcccggggtaccggtaccgggacggtaaacggggccctacgtaacgtacgg

SEQ ID NO: 148788 - DNA, 722 bp, Homo sapiens
  misc_feature: GYAE6OF01CUVLY.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgcccgcctggtaccggcacgaccccaggccagccctccacgcacgctcatctacagtaacaacactcgcttccgttccgggtccctgactcgctttctctggcctccattcccgttagggaacaacgctcgcccctcaccatccgaccggggcccaggcagacgatagaatgtagtattatctactcggtccgtttccgtttagtcgggttcggggtcgtggtcgttaggtttcggggttcggtttcggggacgggtaccgggaaccgtaaaccgtccgggtaaccccgttaccggttacgggtaccgtaacccggaccccggtaacgggtccccgttaccccgggtcccccccggtttaccgggtcccgttaaccccgttcccggtttaccccggtttcccccccggttcccccgttccccgttacccggttacccgtttaacccggttaaacggttaccggggaccgggtccggggtccggttaccgggg

SEQ ID NO: 148789 - DNA, 764 bp, Homo sapiens
  misc_feature: GYAE6OF01DCW4W.15.34.D01.1.454.CMB.1.raw
  modified_base (198)..(198): a, c, t, g, unknown or other
  misc_feature (198)..(198): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtccccgtgggagggacagtcacactcacttgtnccttgaggtctggctcagtctctacttactaactacgccgcctcggtaccgcacgaccccaggccagcctcacgcacgctcactctacaagtaacaactactcgtctaccgttcccggggtaccctagacttccgtctttcctcgtcggtccctacctacttccgttacgggaaacaacggtcctacgaccccttacaccctacgtacccggacccgggggccaacggacgaacggaacgtaacgttaggaagtttggtacgtaagtttactacgttaaccgtcggttaccttttaccgtttaggtcggggttaggggtacggttggtacgtttagggttttcggggtacgggtttccggggacgggtaccggtaaaccgtaacgttccggtaacccggttccgtacgggttacccacggaaccccggtaacggtccccgtcccggtcccccgttaccggttaacccgtaccgtttcccgttaccccgtttacccccaccccggtttccccgtaccggttacccgttaacggtaacgaccgttacgggtcgggcccggtaccgggg

SEQ ID NO: 148790 - DNA, 662 bp, Homo sapiens
  misc_feature: GYAE6OF01DHSOB.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctgggagggacagtcacactcacttgtgccttgaggtctggctcagtctctacttctaactacgccgcctggtaccggcacgaccccaggccagcctccacgcacgctcatctacagtacaaacactcgctccgttccggggtccctgatccgcttctctggcctccactccgttagggaacaaagctcgccctcaccatcgaccggggcccagggcagacgagtgaatgtagtattatcctactcgtccgtttaccgtttagtcgggtggggtcgtgggtacgttaggtttggggttggtttccggggacgggtacgggtaacccgaaacgtccggtaacccggttccgtacgggtccgaacgaccccgaggtcccgtacccgtccccccgttccgggttacctacccgttccgttcccggtttccccccacccccgttcccgtacccgtaccgttaaccggtacgtaccgtacggcggggtcgggtacccgg

SEQ ID NO: 148791 - DNA, 1032 bp, Homo sapiens
  misc_feature: GYAE6OF01BYZSP.15.34.D01.1.454.CMB.1.raw
tcagtctacgtagccacgaccggtgctcgatttagatcgtctgtgttgggtttgggggaaaggccctgaggaaaacaaaccccagctgggaagcctgagaacacttagccttcatgagtgtccccaccatggcctggatgatgcttctcctcggactccttgcttatggatcaggagtggattctcagtactggtggtcgacccgagggacgcctagttccgttccgtcgtaggttccggtccccgtggggaacgggtactacggttaccaacctaccgttcctaacgtttggtacggttcccgtttaggtacgggttccgttggggtaccttaccggtacggtttcccttacctttaacctttaaccttaaaacccgttcccggacccccggttccccggttaacgggggtaacccccgggaccgaaaccccggaaccccccggacgggacccccgtaaccggtccccccttaccccgaacccggacccgtaccccggtacccttaaccctaacgttaccccgttaaaaccgaaaccggttaaaaccccaaaaccgtaaccccgtttaccccggttaccccggttttcccccggggtttacccccggggggttacccctagggtaaccctttccggttaccccgttttcccgtttccggtcgggttaccccctttacccttaaccgggttttaccccgggttaacgggaaaacgtaaccggtccgttacccctacccccgtaaccctacccggtaaccggttacccggggaccccgggggtaacccacggggaccgaaaccggagttaacggtacgggtaagttacggttacttaacgtttacacccgttaacggttcgttacccgttttaccgttagggttaccgggtcggggtacggtttcgggtaaggttttcgggggtttccggggttacggggttaccgggaaccgggggtaaccgtaaaccggtacccggttaccgggtaacccgttacccgggtttaaggccccgtaaccggggtacccccggg

SEQ ID NO: 148792 - DNA, 608 bp, Homo sapiens
  misc_feature: GYAE6OF01EIQU3.15.34.D01.1.454.CMB.1.raw
  modified_base (353)..(353): a, c, t, g, unknown or other
  misc_feature (353)..(353): n is a, c, g, or t
  modified_base (373)..(373): a, c, t, g, unknown or other
  misc_feature (373)..(373): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcgttccgggtcctgatcgcttctctgctcactcgtaggaacagctcgcctcacancggaccgggccagcagaganagtatgtagtattacactacgtcgtcgtttaccgttagttgggtcgggtggttcggtcgttagggttttcggggttcggttcgggacgggtaccgggtaaacccaaacggttaccggtacccgtaccgggtacgtaccgaccgtacccgaacgtccgtcccgtccccgttacggtacctcgttcccgttcctcccctccctccgtcccgctacggtacacgtcggcggcggtcgg

SEQ ID NO: 148793 - DNA, 688 bp, Homo sapiens
  misc_feature: GYAE6OF01BDHA9.15.34.D01.1.454.CMB.1.raw
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactcgccgcctggtaccggcacgaccccaggccagcctccacgcacgctcatctacagtacaacnctcgctcgtccgggtcctgctcgtcttctctcgctcnctctaggaacacgctcgccctacaccacgtccggaccggggcccaggcacgacgtatacgtaagtgtacgtattacgtactacgtcggttctttaccgtttagggtcggggtcgggggtcgtcgggttacggttacgggtttttacggggtgggtttccggggacgggtaccgggtaaacctaaccggtaccggtacccggttaccggttacggtaccgaaccgggtaccccgaacggtccctacccgggtcccccttacgggtcccttaacccgtttcccgttacccgttaccccctccccgttaccgttacccgttaccgtaaccgtacggtaccgtcgggaccgggtcggtaaccgg

SEQ ID NO: 148794 - DNA, 633 bp, Homo sapiens
  misc_feature: GYAE6OF01BZENQ.15.34.D01.1.454.CMB.1.raw
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtcgacccaggacgccatcgttctcagtcgtccccgtggaggacagtcacactcacttgcgtccttgagtctggactcgagtctcttacttactaaccgtaccgccgccgtacggtacccggcaccgaccccgaggcccacgccctaccncgccaccgcctacacttccaactagtaaccaaactaccgtcncttaccgttccgtacgtccctgactccgtcttctcgtacggtcctcctaacttccgtaggaactaacggtctccgaccctcaccgtacgtcccggaccgggcctacggcaaggactagagtaatcgtagtacttacgtaccgtacgttcgtcgttccgtttagtcggttcggttcggtgtacgttgtttgggcggttcgggacggtacgacctaacggtcgtacccgttacgtcggtcccaaccgg

SEQ ID NO: 148795 - DNA, 589 bp, Homo sapiens
  misc_feature: GYAE6OF01CTHM2.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagcctccacgcacgctcatctacagtaacaacactcgcttccttccgggtccctgactccgctttctctggctccatccgttgggaacaaagctcgccctcaccatcgacggggccaggcagacgatgaatgtagtattactcactgtccgttctttagtggtgggcgtggtctagtttcgggtgttcgggacggacgggacaacgtcgacccgtcgtacgtcgacgcccgaggcctccggccccgtcgtccaccgttccgtccgttcccccaacccgttcccgtaccgtaccgttaccgtaagtaccgtacggcgggtccggtaccgg

SEQ ID NO: 148796 - DNA, 737 bp, Homo sapiens
  misc_feature: GYAE6OF01C02BP.15.34.D01.1.454.CMB.1.raw
  modified_base (127)..(127): a, c, t, g, unknown or other
  misc_feature (127)..(127): n is a, c, g, or t
  modified_base (386)..(386): a, c, t, g, unknown or other
  misc_feature (386)..(386): n is a, c, g, or t
  modified_base (601)..(601): a, c, t, g, unknown or other
  misc_feature (601)..(601): n is a, c, g, or t
tcagtctacgtagccacgaccggtgctcgatttagatcgtctgtgttgggtttgggaacctatgaacattctgtagggccactgtcttctcctcggactccttgcttatggatcaggagtggattcncagactggtggtacgacccgaggagccagtcgttctcgagtcgtccccgtgggacggacacgtcacactcacttgtcgtccgttagcggtccgtggctcgacgttctacttacttactaaacgtcgcccgtccgtcggtaccgcaacgaccccgaggccagcctaccgacgctacgctacactactacgaacgtaaccaaactcgtcgtaccgttccggttacccgggtcctacgtcgtcctctttcgcgtcgccttcncgtacggtaggaaactacgtctccgacctacgactggccggaacccgggcagtcgaacgtacgtagtaaggaacgtttgtaagtactttacggtacgtacggttcgtacgtttaacgttggtcggggacgggtttcgtaaggttcgtttagggtttcgtcggtacgggacgggtaacgaaccgtcggtaaccgccggttaccggtacggtaaccnccgtaacccgtacgggcccgtaccccggttccccgtaaccgtaccgttaacccgttccgtaccccgttaccccgtacccctttaccggacccgttacggaaaccttcggaccggttcggaccgggtcccggtcggg

SEQ ID NO: 148797 - DNA, 793 bp, Homo sapiens
  misc_feature: GYAE6OF01B70TI.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtcgtccccacatggcctggatgatgcttctcctcggactccttgcttagtggatcgagggagtggtattctcgagtacttggtagggtcgaacccgagggacgtcctagttccgttctacgtacgttccgtcccgtagggaacggtacagtccaacgtctactacgttggtcgtccgttggacgttcgtcggtctcgtacgttcttaccttacttactaaccgtccgccgtccgtcgggtaccgcgaaccgacccgacggaccaccgtccctaccgaccgccgacgtcctctaactacctaacgaacgtaaaccaaaccgtccgtccgtaccgtttcccggtttacccggggtcccttaggtaccgttccgttcctttccgacgtccgtaccttaccgtacgttaccgggttacgaaacgtaccgtccgtaccgtcccctaacgaccgtacggacccggaccggggtcccgacggtacgaaggacgtagaaggtactaggttattaaccgttactaccggttacgtccgtttaccgtttacgtttacggtcggggttacgggttcggttacggttggtttacgggtttggggttacccgggttacggggaccggtaacgtaacccgtacggtaccgttacccgttagggtaaccgtcggaaccccggtacccgg

SEQ ID NO: 148798 - DNA, 995 bp, Homo sapiens
  misc_feature: GYAE6OF01CLGUO.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtcgtccccaccatggcctggatgatgcttctcctcggactccttgcttatggatcgaggagtggattctcagtactgtggtcgacccgaggacgccattccgttctacgagttcgtccccggtgggacgggtactacgtccaaccgtactcctacgtttgtacgtccgtttaggacggttcgtcggtctacgtacgttccttacctttaaccgtttaacgttaaccgtacccggcccggttaccgttaccggggtaccccgaccgacccgaaccccgcggccccaccgccccgtacccgaccggcctaccgtccctacgtacttcctaaacgtaacgtaaccaaacctacccgttccgtcccgtttcccggttacccgggttccctacgtaccgttcccggtccttttccgtacggtccgtacccgttcccgtaaccgtttcccgggttaaaccggaaaaccgtacgttacccggttacccctacccccttacccggtaacccgtaaccggttaacccccgggggaccccgggggtaaccccccgaaacggggtacccgaaaacgggtaacccggtaaggttaaccccgttaaagggtttccggttaagtttaaaccttaccggtacccgttaaccgggttttccggttacccgttttttaacggtttaccggggtggggggttcccggggttaaccgttcgggggtttaaacggttttccggggttttcgggggggttacccggggtttacccgggggaaacccgggggttaaaacccgggtaaccccccgttaaaaacgggtcccgggggtttaaacccccttacccggggtttaacccggtaaacccggggtaaacccccgtaacccccgggg

SEQ ID NO: 148799 - DNA, 636 bp, Homo sapiens
  misc_feature: GYAE6OF01C4N8F.15.34.D01.1.454.CMB.1.raw
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (428)..(428): a, c, t, g, unknown or other
  misc_feature (428)..(428): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctgggagggacagtcacactcacttgtgccttgaggtctggctcagtctctacttctaactacgccgcctggtaccggcacgaccccaggccacgcctccacgcacgctcatctacagtacaaacactcncctcgttccgggtcctgactcgcttctntcgtctccatccgttagggaaacaacgctacgccctacaccgtacgtaccggaccgggggacccagggactaacggacgtacgtagaatggtagtattacnctacgtcgtccgtttacgtttagtcgggttggggcgtgggtcttaggtttggggtcggtttacgggcgggtaacgggtaacaacggttcggacccgttcgtacggtccaccggaccgacggtccgtccgtaccccgtcggtcctaccgttcgttacccgtcccccgccttcccgtcctacgtaccgacgtaccgcggcggtcgggtcg

SEQ ID NO: 148800 - DNA, 744 bp, Homo sapiens
  misc_feature: GYAE6OF01DX6A4.15.34.D01.1.454.CMB.1.raw
  modified_base (311)..(311): a, c, t, g, unknown or other
  misc_feature (311)..(311): n is a, c, g, or t
  modified_base (526)..(526): a, c, t, g, unknown or other
  misc_feature (526)..(526): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactggtggtgacccaggagccatcgttctcagtcgtccccgtggagggacagtcacactcacttgtcgtccttggacggttcgtgggctcgagttccttaccttaacctttcctaaacgtccgcccgtcccgtcgggtaccggcaaccggaccccgtacggccacgtccctccgacgccnccgctcactctactacgtaacaaactactcgtccgttccgttcccggggttcctcgtacgttcgtccgtttcgtccgtcggtccctaccgttaccgttacccggtttaacgggaaactaaacggtcctacccggtcccttacccgaactaccggtacccgggacccggggaccgtacgggacgaacggtacgagtacgtaagtggtactattacncctacgtcgtttacgtttaccttgggttgggtcgggtcgtcgggttcttagggtttgggttcggttcggggaggaccgggtaactaacggtacgtcgtacggtaccgagtccgaccgaccgtccgtcccgtcccggtccgtacctaccgttccgttcccgtccccggtcccgttacccgtccgtacggtaccgagtaaccggcgtcgggcggtaccgg

SEQ ID NO: 148801 - DNA, 954 bp, Homo sapiens
  misc_feature: GYAE6OF01ARB2T.15.34.D01.1.454.CMB.1.raw
  modified_base (194)..(194): a, c, t, g, unknown or other
  misc_feature (194)..(194): n is a, c, g, or t
tcagtctacgtagccacgaccggtgctcgatttagatcgtctgtgttgggtttgggaacctatgaacattcgtgtaggggccactgtcttctcctcggactccttgcttatggatcagggagtggattctcagactggtggtcgacccaggacgccattccgttctcagtcgtcccgtggagggacagtccacnccgtactacctttgttcgtacccgtttggacgggtcgttcgggccttaccgtacggttccttccttaaccgttttaccttaaccgtacccgcccggtacccgttaccgggtacccgggacaccggaacccccgtagggcccctaacggccctccccgacccggacccgaccgtacctaccaccttaccgttaacgtaacggttaaacccaaaaaccctaccgttccccgtccggttttccccggtttaccccggggggttaccctttcggtaaccgtcccggtttacccttttccggttcctaccgggtccttaccccgtaaccggttttccgggtacgggtaaaacctaaaccgggttccctacccggttacccctacccgtaaaccgacgttccccgggacccgggggaccggacgtaccgaacgggaccgtaaggtacggtaagtccgtaaggttacttacgtaccgttaacgtccgttaccgtttactttcgggtacgggttcgggtaccgggttacggtcggtttagggttttcgggggttcggttacggggtaccggtaaccgggttaacgaaccggttacggtacccgtacggtaccgtacgtacccggactacccgggtccgtccccgtacccgggtccgtaaccggttccctttacccggttcccttaccccccggttccccttacccggttaccccggtaaccgttacggttacccggacggttaccgggggcgggttccggaaaccggg

SEQ ID NO: 148802 - DNA, 920 bp, Homo sapiens
  misc_feature: GYAE6OF01EAIML.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactaccgccgcctggtaccggcacgaccccaggccacgcctccacgcacgctcatctacagtacaaacactcgctccgttcccggggtccctgtactcgtcgtttcctcgtcggtcctcctacgttacccgtttaaggggaaaaccaaaacggtccgtaccgtaccccctacccgtaaccccgtaaccggttacccgggaacccgggggggaccccgtaaccggggacccgaaacgggtaaacccggtaaacgttacgggtaaaaagtttccgggttaagttaaaccgtttaaccggttacccttaacccggttaccgggtttaccccggtttttacccggttttaaagggtttcgggggtaccgggggggtttccgggttacggggtttacccgttttaaggggttttttacggggggttcggggttttaccccggggggaccgggggtaaacccggggttaaacccgtaaaaccgggtttacccgggttaacccccggttacccgggttacggggttaaccccaaccggggaaccccgggtaacgggttaccccggtccccgggtacccccggttacccgggttacccctaccgttttacccggtttcccgtttaccccgtccgtttacccccttcccggttaccgtacccgttaaacggttaaccgtaacggttccggacgggtacccgggg

SEQ ID NO: 148803 - DNA, 675 bp, Homo sapiens
  misc_feature: GYAE6OF01BBEM3.15.34.D01.1.454.CMB.1.raw
  modified_base (545)..(545): a, c, t, g, unknown or other
  misc_feature (545)..(545): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattcgtcagactgtggtcgacccaggagccatcgttactcagtcgtcccgtggagggacagtcacacgtcacttgtgaccttggacggtctggtctcgtagttcctcttacttacctaactcgcccgcgtcggtaccgcacgaccccgaggaccagccctccgacgcaccgtctcaatcctaacgaacgtaaccaaactaccgtccgtaccctttccggttcccggggtccctagacttccggttaccttccgttcggtccggtccttacccgtacgttccggttacggaaacctaacgtcctacgacccctaccaccgtacgtaccgggacccggggcccaggactacgacgtatagtatgtntattcactcgtcgtcgttcgttagtgggtcggtgtcggtcgttaggttttcgggtcggttacggggacgggtaaaccggtacccgtacggtacccggtacgttcccggaggtccgaaccggtaaccccgg

SEQ ID NO: 148804 - DNA, 751 bp, Homo sapiens
  misc_feature: GYAE6OF01BW3MY.15.34.D01.1.454.CMB.1.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
tcagtctacgtagccacgaccggtgctcgatttagatcgtctgtgttggggtttgggaacctatgaacattctgtaggggccactgtcttctcctcggactccttgcttatggatcaggagtggattctcagactgtggtgacccaggagccattcgttctcagtgtcccctggaggacagtcacactcacttgtgtccgttggaggttctggctcagtcctctacttctaactaccgcccgtccgtacgggtacccggcacggacccccgaggcccacgccctccaccgcacgctcatctacagtacaaacactccgactccgttccgggtccngtatcgcttcgtctcggcttccnctccgtaggaacaagcgtccgccctacaccactaccggacccgggggccgacggcgacgacgtatacgaagtggtacgtagttactaccgtacttcggtccgtttaccgtttagtagggttcggggtccgggttagggttacgtacgggtttttcgggggttacgggtttccggggtaccgggggtaaccggggtaaccggtaaacccgttaccgggtaaccccgttacccgggttacggtaccgaaccggacccgtaaaccgggtccccggttacccggtacccccccggtttccggtaccccgtaccgtttccccgtcccggttcccccgttccccccgtcccgtcccgtaccgttacgtaacgtccgtacgggtaccgggcggtcccggg

SEQ ID NO: 148805 - DNA, 644 bp, Homo sapiens
  misc_feature: GYAE6OF01BOD0W.15.34.D01.1.454.CMB.1.raw
  modified_base (297)..(297): a, c, t, g, unknown or other
  misc_feature (297)..(297): n is a, c, g, or t
  modified_base (392)..(392): a, c, t, g, unknown or other
  misc_feature (392)..(392): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcaccgctcatctacagtacaaacactcnctcgttccgggtcctgactcgcttctctgtctccactccttaggaacaaacgctacgcccctacacctatcgaccggggcccaggacagacgtanagaactgtagtattactactactggtaccttccgtttagtgggttacggggcgtggtaccgtaggttttgggtcggttcggggacgggacgggaaccctaacggtcggtacccgttccggtacgtcgaccacccggaacggtccgttacccgcccccgttcgtcccgtaccgttccgttcccgttccccctaccccgtcccgttacccgtaccgttaccggtaccgtacggtcggagggtcccgggtaccgg

SEQ ID NO: 148806 - DNA, 721 bp, Homo sapiens
  misc_feature: GYAE6OF01AWKN3.15.34.D01.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtnccttgaggtctggctcgagtctctactctaactacgccgctcggtaccgcacgacccnggaccacgcctccacgcacgctcatctacagtacaactattcgctcgttccgggtcctgactcgcttctcgtcgctccacgtccgttaggaacaacgtctcgaccctcaaccgtacgtaccggaccgggggcccacggaccgaaacggaccggtaacgtaggaacgttggttacgtaactttacgtaacctcgtacggttccggtttaccgttttagtcggggtcggggtacgttcggtacgttacgggttttacggggtcgtttacggggtaccgggaacggtaacccgtaaacgtccggtaacccgtccgggttacgtccgtaaccgacccggtaacgggcccttcccgggtacccccgttcggtacccttaaccggttcccttccccgttacccccgccccgtttccccgtcccggtaccgtaacgttaccggtaagtcgggtaccggtcccgggttaaccggg

SEQ ID NO: 148807 - DNA, 786 bp, Homo sapiens
  misc_feature: GYAE6OF01B4Y0F.15.34.D01.1.454.CMB.1.raw
  modified_base (243)..(243): a, c, t, g, unknown or other
  misc_feature (243)..(243): n is a, c, g, or t
tcagtctacgtagccacgaccggtgctcgatttagatcgtctgtgttgggtttgggggaaaagccctgaggaaaacaaaccccagctgggaagcctgagaacacttagccttcatgagtcgtccccaccatggcctggatgactgcttctccgtcggacttctgcttatggatcgaggagtggtattctccgagactggtcggtcgacccgaggacgcctagtcgttctcgagtccgtcccgnggacggacagttacactctctacgtttgcgtccgttggacgttcgtcggccttacgacgttaccttccgttaacctttactaaccgtaccggcccgtaccggttacggtacccgggtacaaccggtacccccaggtccctaacccggtcccgtaccgaccgtccgaccgtaccttcctactaaccttacgaaacgtaaccaaacctcgtccgttacgttccgtttccgggttacgggttcccgtagtaccgtttcgtcctttcgtcgttacccggtccttaccgtacgttccgtaacgggaacctaacgtccgttacccgtaccgtaccaaccggtacgtaccgggaacccggggtacctacgggcgtaacgtacgaacgtttcggaagttcgtagtacttcggtaccttacggtccgttcgttacggtttagtccggttagggtccgggtagttccggttaacggtttgggcggttcccgggtagggaacccggttaaccgtacggttacccggacgttacccgttaggcgtaaaccccggg

SEQ ID NO: 148808 - DNA, 828 bp, Homo sapiens
  misc_feature: GYAE6OF01AVU8E.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggtattctcgagactgtggtgacccaggagcctatcgttctcgagtcgtccctgggaggacagtcacactcacgttgtcgtccttggtacgttcgtgggcgtaaaaaaaacgtgtccttacttaccttcctaaacttaccggacccgtccgttcgggttacccggccaccggaccccgtacggccgacgccctaccaccgccaccggcctcacttaccgtactaacggtaaccaacctaacctcgtccgttccggttcccgggttacctcgtactccggtcttacgtctcggccttaccgtacgttaccggttaaggaacctaaacggtccgttaccgaccccttacccgaccgtacggacccccgggtacccggggaccgaccgggtacgaaccggtaacgtaacgtcggaagttacgttacggttaacttacgacttacggttcgttaccgtttaacgtttcgggtcgggtcgggtcgtcggttacggttacggtttcgggtaccgggttcgggtacggggtaaccgtaaccgtaaccgttacggtacccggtaccgtaggcctaaaccgggtcctacgggtaccctaccccgggtccgtcccggttactaccgtttccggtttacccggtaccccgttccccgttcgttaccccggttattaaccccgggttagaaccggtcggtaccggggtcggttaccggg

SEQ ID NO: 148809 - DNA, 745 bp, Homo sapiens
  misc_feature: GYAE6OF01B65LT.15.34.D01.1.454.CMB.1.raw
  modified_base (617)..(617): a, c, t, g, unknown or other
  misc_feature (617)..(617): n is a, c, g, or t
  modified_base (665)..(665): a, c, t, g, unknown or other
  misc_feature (665)..(665): n is a, c, g, or t
  modified_base (697)..(697): a, c, t, g, unknown or other
  misc_feature (697)..(697): n is a, c, g, or t
  modified_base (707)..(707): a, c, t, g, unknown or other
  misc_feature (707)..(707): n is a, c, g, or t
  modified_base (738)..(738): a, c, t, g, unknown or other
  misc_feature (738)..(738): n is a, c, g, or t
tcagtctacgtagccacgaccggtgctcgatttagatcgtctgtgttgggtttgggggaaagccctgaggaaacaacccagctgggaagcctgagaacacttagccttcatgagtcgtccccacatggcctggatgatgcttctcctcggacttccttggcttatggactcgaggagtggattctacagtacttggtggtcgacccgaggacgcctagttccggttctcgtacggttccgtccccgtggggaacgggactacgttaccaacctaacttcgtacgtttggtcgtaccgttttgggaacgggttctacgggcttacgtaggttccttaacttacgtttaccaaccgttaccgcccggtccgtacggtacccggactaccggaaccccgaggacccacggtccctaccgacgccgaccgtctcactacctaacgacgtaaaccaacttccgccgtcggtttacccggttccccggggtacctacggtacgttcccgtccgtttcctacgtcggtaccctttaccgacgtttaccgaacggtaaactacgccgtttcccgacccgtacaaccgtaggtccccgggaaccgggggtaccaggaccagggtanaacgtcggtaatgtacttagttaccccgttatgttaccgttcgttagngggttccgggattcggacgttggtttccgggngttaccgggnggtaaccgactacggtcgcccttaaggcgcncgtaccg

SEQ ID NO: 148810 - DNA, 632 bp, Homo sapiens
  misc_feature: GYAE6OF01BWH4N.15.34.D01.1.454.CMB.1.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (489)..(489): a, c, t, g, unknown or other
  misc_feature (489)..(489): n is a, c, g, or t
  modified_base (565)..(565): a, c, t, g, unknown or other
  misc_feature (565)..(565): n is a, c, g, or t
  modified_base (623)..(623): a, c, t, g, unknown or other
  misc_feature (623)..(623): n is a, c, g, or t
tcagtctacgtagccacgaccggtgctcgattagatcgtctgtgttgggtttgggaacctatgaacattctgtagggccactgtcttctcctcggaactccttgcttatggatcaggagtggattctacagactggtggtgacccaggagcctatcgttactctagtcgtccctggaaggacagtcacactctacttgtgaccttggagtcgtggactnacgtctctacgttcaactacgcnccgtggtaccgctacgacccaggccagcctcacgtcacgcttacactctaccaagttacaaaacctntccgtactttccgtcccgggtaccnggtactccgtacttctccgagtctctacgttccgtaggaacaagtccngcctacgcaagccgacgggcaggcagtactnagtaacngtacgcttaagctatggttaccttcttaacggttggtaacggtcggtacggtacttaggttttcggggngttaccggggtacggaaccgggtacctaacggtccgacccggtttaccgacggtacgacgtaccgacgcggtaccnccccgttgaccgtactcccgttacttcccggccttccgacgtcctacggttacacgtncgtacgcgg

SEQ ID NO: 148811 - DNA, 599 bp, Homo sapiens
  misc_feature: GYAE6OF01CFRSY.15.34.D01.1.454.CMB.1.raw
  modified_base (325)..(325): a, c, t, g, unknown or other
  misc_feature (325)..(325): n is a, c, g, or t
  modified_base (414)..(414): a, c, t, g, unknown or other
  misc_feature (414)..(414): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtcgacccaggacgccatcgttctcagtcgtccccgtgggaggacagtcacactcacttgtcgccttgaggtctggctcagtcctcttacttctaactaccgccgtccgtggtacccggcacgaccccgnggcccaggccctccgacgccacgcctacactctacgaacgtaacaaacactcgtccttccggttcccggggtccctgacttcgctttcncgtcggctccatccgttaggaacaacgtctcgtcccctacaccacgtccggaccggggcccaggcacgcgatagaagtgtgtattatctacgtcgtcttcgttagtggtgggtcgtgcgttaggttcgggtggtcgggcggacggaactaacgtccggaccgttacgacggtccgacgtacccgg

SEQ ID NO: 148812 - DNA, 735 bp, Homo sapiens
  misc_feature: GYAE6OF01AI5A2.15.34.D01.1.454.CMB.1.raw
tcagtctacgtagccacgaccggtgctcgatttagatcgtctgtgttgggtttgggaacctatgaacattctgtaggggccactgtcttcctcctcggactccttgcttatggatcaggagtggattctcagactgtggtgacccaggagccatcgttctcagtcgtccccgtggagggacagtcacactctacttgtgccttggacggtctggctcagtctctacttactaactacgccgtccgtcggtaccggcacgaccccgaggcctacgccctccgacgccaccgctacacttacctaacaacgtaaccaaacctaccgtccggtcctttccggttccccggggtccttcgacttccgtctttcctcgtcggtccctcctacgttccgttaaggaaaccaagtccttccgccctacacccgtacgtaccgggaccggggcccaggaccgacggaacgtagtacggaagttgtacgtacttacgcctacgttcgttccgtttacgttttggcgggttgggacggttggttacgttgggtttcggggttccggtaacgggcgggtaaccgtaaccgtacgtaccggtaccgtccgtacggtaccacccgtaccgtccggccgtccccggtccccgttccgtacccttacccgtcccgtttccccgtacccctccccggttccgtcccggttaccgttacggacgttacgggccggtccgggtccgggtacgg

SEQ ID NO: 148813 - DNA, 852 bp, Homo sapiens
  misc_feature: GYAE6OF01CNRXN.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtcgtccccaccatggcctggatgatgcttctcctcgacctccttgcttatggatcgaggagtggattctcgagactggtggtacgacccgaggacgccattccgttctcgtacgtccgttccccgtaggggacgggactacggtcctacctactctacgtttggtccgtccgtttaggacggttccgtacggtccgtaccgtcgttcctttaccttacctttacctaaaccgtcccgtacccggtcccgttaaccgggtacccggacccgaccccggaacccccgtcggaccccaccggtcccctccgaacccgcctaaccggtccctccgacttaccgtaactaaccgtaaaccaaccgtaccgtcgtacccgttcccggttacccggggtccctagtccgtccgttaccttcgtccgttcggtccctacccgttacgttacccggtaacggaaaccaccgtcctcccgtaccctacctaccgaccgtcccgggacccgggggtacccaggtacccgaagtcggtaatacggtaagtacggttaacgtaattaccgtaccggtacttccggttcctttttacggtacggttcggggcgggttcggtaccggttggttttacggggttttcgggtaccggggttacggggacccggggttaaccggtaaacccgttacgggttacccccggtaaccgttccgggtaacccgttccgaacccgggttacccggg

SEQ ID NO: 148814 - DNA, 925 bp, Homo sapiens
  misc_feature: GYAE6OF01EKLDP.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtccccgtgggagggacagtcacactcacttgtgtccttggaggtctggctcagtctctacttactaactacgcccgccgtcggtaccggcacgaccccgaggccacgccctccacgcacgctcactctacacgtaacaaacacctcgccttccggttcccggggtccctgacttcgtcctttcgttcgtcggtcctcctacgttaccggttacgggaaaacctaaacggtcctaccgtccccttaaccacccgtacgtccccgggaacccgggggacccaaggggacccgaacggtaaccggtaacggttaacggtaacgtttacgggttaacgttaacgttttaacgtacccgttaacgttccgggtttaccccgttttacccgttttaggttcgggggttacgggggtacgggtttacgggttacggttttacggggttttcgggggtttccgggtttaacggggggaccggggtaaaccgggtaaaccccgtaaaaccggtttcccgggtaaccccggtttaaccccgggtttaacggggtaacccgtaacccgggtaacccccggtaaccggggttcccccggttacccccggttcccccccgggttttacgggtacccccttaaccggtttcccccgtttacccccggtttacccccccgttaccccccgtttacccgtaaccccggttacccggtttaaacccggttaccggttacccggttaacgggtcccggggttaaccggggtacccggg

SEQ ID NO: 148815 - DNA, 696 bp, Homo sapiens
  misc_feature: GYAE6OF01BKUZ1.15.34.D01.1.454.CMB.1.raw
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcagggagtggattctcagactggtggtgacccaggagccattcgttctcagtcgtccccgtgggagggacagtccacacctcacttgtcgccttggaggtctggctcncgtctctacttctaactccgccgccgtggtacccggcacggacccnggcccacgcctccacgcaccgctcactctaacacgtaacaaacnctcgccttccgtcccgggtcctgactcgtccttcctcgtcggtcctaccgtacttccggttacgggaaactaaacgccgtccgtaccccttaccacccgacggttacccgggacccggggggacccacgggtccgaaggaaccgtacgtaggaagttcgtagtaacttactaccgtacgttccggttccgtttacgtttacgggttacgggttcgggggttccggttcgggttacgtttagggtttcggggttcggggttacgggccggggtacggaaaccgtaacggtacggtcccggtaaccggttgggccgccggtaacccgg

SEQ ID NO: 148816 - DNA, 799 bp, Homo sapiens
  misc_feature: GYAE6OF01CRDUQ.15.34.D01.1.454.CMB.1.raw
  modified_base (213)..(213): a, c, t, g, unknown or other
  misc_feature (213)..(213): n is a, c, g, or t
  modified_base (431)..(431): a, c, t, g, unknown or other
  misc_feature (431)..(431): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcgaggagtggattctcgagactggtggtcgacccgaggacnccattcgttctcgacgtcgtccccgtgggacggacagtccacactctacgttcgtcgtccgttggacggttcgtcggtcttccgacgttccttacgtttaccttacctaaccgtaccgcccgtccgtacggtacccggaccaccgaccccgcggacccacgccctaccgaccgtccgaccgtccacgtaactcctaaccagtaaaccaactaccgtcnccgttcccggttcccgggtcctagacgttcgtcctttctaccgtcggcccttacccgtgttacccggttaacgggaaacctaacgtcccgtaccgtcccccttaaaccgaccgtaccggtacccgggaccccgggggaccccgtaacggaccgaacggaccggttaagttaccggtaattacgggttcgttaacttaccgtaccgtagttccggttcccgttttaggtttcgggtcggggttcgggggttacggttcggttacggtttggggtttcgggttacggggttaccggggacgggtaacccggtaaccgtaccggttaccggtacccgttaccggttacggtccgtaaccccggtaccccgg

SEQ ID NO: 148817 - DNA, 694 bp, Homo sapiens
  misc_feature: GYAE6OF01BRCUF.15.34.D01.1.454.CMB.1.raw
  modified_base (129)..(129): a, c, t, g, unknown or other
  misc_feature (129)..(129): n is a, c, g, or t
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
  modified_base (475)..(475): a, c, t, g, unknown or other
  misc_feature (475)..(475): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggatttcncagactgtggtgacccaggagccatcgttctcagtcgtccctggaggacagtcactactctacttgtcgtccttggacggttctggtctcgacgtcttctacttacgtaactaccgccgtcgtacggtaccgcacgtaccccgnggaccagtccctccgaccgcaaccgctacattacctaacacgtaaccaaactacctccgtccttccggtcccgggtcctgtactcgtcttccnctggcctaccgtactcgtaggaactacgtcctacgtcctacaccgtcgaccggtccggggacctagggtaccaacggtacgtagtacggaacgttcgtacgtacttacncgtacgtcggtacctttccggttaggttcgggtacgggtcgtacggtacgttacggtttcgggtacgtcgggtacgggaaccgtaacgaccttacggtaccgtacggtacgtaccgacgtaccgacggtccctcccggtccgttaccgacttaccgtccgtacccttcccgtacccgtcctaccgtacccgtagaccgtactcgggaccggcggtacgg

SEQ ID NO: 148818 - DNA, 839 bp, Homo sapiens
  misc_feature: GYAE6OF01AQLA4.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtcgacccaggagccatcgttctcagtcgtcccctggaggacagtcacacctctacttgtcgccttgacggtctggcctcacgtctcttaccttctaactaccgccgccgtcggtaccgcaccgaccccgaggccacgccctaccgacgccaccgccttcactccgtacacgtaacaaaccgtactccgcctttaccgttccccggggtccctgtacgttcccgtcctttaccgtcgttcggtccctaccgtacgttccgtttaacgggaaacctaacggtcctcccggtacccctacccgaaccgtacgttacccgggacccgggggaccccaagggacccaagggtaaccctaggtaaacggtaacgttcgttaacgtacctttaagttacccgtacgtttcgtacccgttttaccgtttaggtacgggttcggggtaccgttggtacgtttacgggttttacgggtccgggttacgggaaccgggtaacccgggttaaccgtaacggtttcccgtaacccggttacccgttagggtacccgtaacccgggtacccgttaaccgggccccggttacccccgtccccgggttaccggtacccttacccggtttcccgttacccccgttaccccgtcccccttcccggttaccgtacccgttaccggttaacgtacccggcggtacgggtccccgtaccggg

SEQ ID NO: 148819 - DNA, 737 bp, Homo sapiens
  misc_feature: GYAE6OF01BMGE7.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcgaggaggtggattctcagacgtggtggtcgacccgaggacgccagttcgttctcgtacgtcgtcccgtggagggacagtcacactctacttgtcgtccttggacggtcgtggctcgtagtccttacttaccttacctaaccgtaccgccgtccgtcgggtacccggacgaccgacccccgacggcccgacgtccctaccgccgcaccgctcactaccactaacgtaacaaacctccgtccgtaccgttcccggttcccgggtcctacgcttccgtcttccgtcgtcggcctacctacgttaccggttaggaacctaacgcctaccgtaccccaccaccgaccgtacccgggaccggggacccacgggtccaacggacgtaagtacgtaagttcgtagtaactttacgtaccgtacgttcgttaccgtttccgtttaggtcgggtcggggtcggttgggtacgtttggggtttggggttccgggttaccggggaccggggtaacggtaaacccgtaacggtccggtaacccgggttacgtaccgggacgtaacccggtacccggg

SEQ ID NO: 148820 - DNA, 921 bp, Homo sapiens
  misc_feature: GYAE6OF01B2K6H.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtcgtccccaccatggcctggatgatgcttctcctcggactccttgcttatggatcagggagtggtattctcagactggtggtacgacccgagggacgacctattccgtttcctacgtacgttccgtccccgtaggggtacggaacctagtacccaacctaaccttacctacgtttcggtcgtccgtttggacgggttccgttcgggccttacgtacggtttccttacccttactttaccctaaaccgttaccccggtcccgtaccgttccggggtaccccggacgaccggaccccccgaggtacccaaccggtccctacccgacgcccgacgtcctccgtaactctaaccgacgtaaaccaacctaccttccgtaccgtttcccggtttccccggggtacccgttcgtaccgttccctactttcccgttaccggtgtcccttacgtaccgtttcggtaacggaaaaccaaccgtcccgttaccgtacccctacgtaaccctacgggtacccgggacccgggggacccaacgggaccgacgtaaccggattaacggtacgtttcggtaattaccttacgacccgttagtcccgtttaccgtttaacgggtttcggtcggggggttaacgggtccggtttacgggttacggtttacggggtttaccggggtttaggggttaccccgggggtaaacgggggaaacccgggtttaaacccggtaaaccgggtttccccgggtaaaccccggggtttacccggttaaccccgggttaaccggggtaacccccgggttaaaccccggg

SEQ ID NO: 148821 - DNA, 527 bp, Homo sapiens
  misc_feature: GYAE6OF02FMWUV.15.34.D01.1.454.CMB.1.raw
tcagtctacgtagccacgaccggtgctcgatttagatcgtctgtgttgggtttgggggaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctgctccatccttggaacaagctgccctcaccatcacggggcccaggcagacgatgaatgtgattatcactgcgttcctttatgtggggcgttggctagtttgggtgttcgggcggaggaccaacgtcgaccgtcctaggtcagacccg

SEQ ID NO: 148822 - DNA, 537 bp, Homo sapiens
  misc_feature: GYAE6OF02GX80D.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgactcgcttctctggctccatccttgggaacaaagctcgccctcaccatccgacggggcccaggcagacgatgaatgtgtattatcactgcgttcctttatggtgggcgtggctagtttgggtgttcgggcggtaggaccaacgtcgaccgtcgtaggtcacgacccg

SEQ ID NO: 148823 - DNA, 576 bp, Homo sapiens
  misc_feature: GYAE6OF02HSKOY.15.34.D01.1.454.CMB.1.raw
tcagtctacgtagccacgaccggtgctcgatttagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgtctttatcgttacttatgtcagcattcgcacttctgatacctccagcatgcctcacagcacaccttcacaggcttacagaacgcctcccctaccaacaacgcataacgcgtcgctgccgcacgcttcggtgcattcggtttacgccccgttacactccttcccgcctacttcctagacgtcttacgtagtacg

SEQ ID NO: 148824 - DNA, 517 bp, Homo sapiens
  misc_feature: GYAE6OF02G6QWZ.15.34.D01.1.454.CMB.1.raw
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (507)..(507): a, c, t, g, unknown or other
  misc_feature (507)..(507): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctgctccatccttgggaacaagctgccctcaccatcacggggcccaggcagacgatgaatgngattancactgcgtcctttatgtggggctggctagtttgggtgttcggcggtagggaccaaactgaccgtctaggtcagcccaagcctgcccctgtcactctcgtcccaccctcctcgctacgtnactgagcggc

SEQ ID NO: 148825 - DNA, 624 bp, Homo sapiens
  misc_feature: GYAE6OF02JACQ3.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcgacgctcactctacacgtaacaactactcgcttcgttccgggtcctgtactcgtcttctctgctcctctccgtaggaacaacgctcgcctacacctacgtcggaccggggccacggcgacgacgtagtagtactgtagtacttactcgtacgtcgtccgttcctttagtcgggtcgggtcgttcggtcgttagtttgggtcgttcgggacgggacggtaaccgtaacgtcgtaccgtccgtacggtcgacgaccgacggccgtccgtccccgtcgtcctaccgttccgtaccgttacccgtacccgttccgtccgtaccgttacggtaccgtaccgtcggtaccggtccggtcg

SEQ ID NO: 148826 - DNA, 540 bp, Homo sapiens
  misc_feature: GYAE6OF02F66TW.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtccccctggagggacagtcacactcacttgtgccttgaggtctggctcagtctctacttctaactacgccgcctggtaccggcagacccccaggccagcctccacacacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggctagtttgggtgttcgggcggagggaccaaacgtgaccgtctaggcagcccaaggcctcgccccctggtccacgtctcgttcccgcccttcctcgtctacggtagacctgacggcggtcg

SEQ ID NO: 148827 - DNA, 580 bp, Homo sapiens
  misc_feature: GYAE6OF02GYNGV.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtccccctggagggacagtcacactcacttgtgccttgaggtctggctcagtctctacttctaactacgccgcctggtaccggcagaccccaggccagcctccacgcacgctcatctacagtacaaacactcgctcttccggggtcctgatcgcttctctgctccatccttgggaacaagctgccctcaccatccgacgggggcccaggcagacgatgaatgtgattatcactgcgttcctttagtggtggggcgtggctagttttgggtgttcgggcggagggaccaaacgtcgaccgtccgtaggtccacgacccgaaggcctccgcccccgttcgggtcctaccgttcgttccgttcccccgaccccttcccgtccggtaccttaccggtacgtaccgtcggacggcgggtccg

SEQ ID NO: 148828 - DNA, 559 bp, Homo sapiens
  misc_feature: GYAE6OF02FXB2R.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttagtggtgggcgtggctagtttgggtgttcgggcggtagggacctaaacgtcgacccgtccgtaggtcacgacccgaaggcctcggccccctcggtccaccgtctcgttccccacccttcccgtcgccgttacgtacgaccgtggacgcgggtcg

SEQ ID NO: 148829 - DNA, 526 bp, Homo sapiens
  misc_feature: GYAE6OF02G41ZD.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttggaacaagctgccctcaccatcgacggggccaggcagacgatgaatgtgattatcactgcgttctttagtggtgggcgtggctagtttgggtgttcggcggagggaccaagtcgaccgtctaggtcacgcccaggctcgcccctgtcacgtctcgttcccaccctcctcgctacgtacgactgacgcggtcg

SEQ ID NO: 148830 - DNA, 578 bp, Homo sapiens
  misc_feature: GYAE6OF02JWV9H.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaacactcgctcgttccgggtcctgactcgcttctctggctccatccgtaggaacaagctcgccctcacctagtccgaccggggcccacggcaaggacgatgaattggagtattactctacgtcgtccgttactttagtcggtggggtcgtggtcgtagtttggggtcgttcgggccgggtaacgggtacctaaacggtcgtaacccggttccgtacggtaccgacgtacccgg

SEQ ID NO: 148831 - DNA, 531 bp, Homo sapiens
  misc_feature: GYAE6OF02I1M6B.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctgctccatccttggaacaaagctgccctcaccatcacggggcccaggcagacgatcgaatgtagattagtcaactgaccgttcctttagtgtggggctggctagtttgggtgttcggcggtagggaccaaagtcgaccgtctaggtcagcccaaggctgcccctgtcactctcgtcccgccctcctcgcctacgtcacgtcgagcggtcg

SEQ ID NO: 148832 - DNA, 621 bp, Homo sapiens
  misc_feature: GYAE6OF02H8L7E.15.34.D01.1.454.CMB.1.raw
  modified_base (342)..(342): a, c, t, g, unknown or other
  misc_feature (342)..(342): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgctttctcctcggactccttgcttatggatcaggagtggattctcagactgtggtcgacccaggacgccatcgttctcagtcgtccctggagggacagtcacactcacttgtgccttggaggtctggctcagtctctacttctaactaccgccgccgtcggtaccggcacgaccccgaggccagccctccacgcacgcncatcacagtaacaaacactcgctcgttccgggtcctgactccgtcttctcgtcggctccattccgtaggaacaaacgtctcgccctcaccacgtcgacggggcccaggacagacgtagtagaagtcgtagtaactttataccgtacttcgttccttttacccgttttagtcgggttacgggggtcggttggtccggttaggttttggggttcggtttccggggacgggtaacgggaacctaacgtcggacccgttaccgtaggttccgacgtaacccgg

SEQ ID NO: 148833 - DNA, 596 bp, Homo sapiens
  misc_feature: GYAE6OF02ITFK3.15.34.D01.1.454.CMB.1.raw
  modified_base (385)..(385): a, c, t, g, unknown or other
  misc_feature (385)..(385): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgaggtctggctcagtctctacttctaactacgccgcctggtaccgcacgaccccaggccagccctccacgcacgctcatctacagtacaaacactcgtctccgttccggggtccctgactcgcttcncgtcgctcctatccgttaggaaacaaacgctcgccctcaccacgtccgaccggggccctaggcacgacgtatagtaagtgtagtattactctactcgtccgtttccgtttagtcgggtcgggtcggttggtcgttaggtttcgggttggttccggggtacgggacgggtaaccgtaacggtcgtacccgtccgtacggtccgacgacccgg

SEQ ID NO: 148834 - DNA, 540 bp, Homo sapiens
  misc_feature: GYAE6OF02IR4ST.15.34.D01.1.454.CMB.1.raw
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
  modified_base (471)..(471): a, c, t, g, unknown or other
  misc_feature (471)..(471): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtcctgatcgcttctctgctcatctggaacaagctgccctnaccatcgacggggccaggcagacgatgaatgtgattancactgcgttctttagngtggggcgtggtctagtttgggtcgttcgggcggaggaccaacgtcgaccgtcctaggtcacgccaaggcnccgtcccctcgtctacgtcgtccgttcccgccctccgtcgccttacggtcgacgtcggacggcggtacg

SEQ ID NO: 148835 - DNA, 571 bp, Homo sapiens
  misc_feature: GYAE6OF02GV527.15.34.D01.1.454.CMB.1.raw
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (455)..(455): a, c, t, g, unknown or other
  misc_feature (455)..(455): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtccctggagggacagtcacactcacttgtgccttgagtctggctcagtctctacttctaactacgccgcctggtaccggcacgaccccaggccagccctcacgcacgctcatctacagtacaaacnctcgctcttccgggtccctgactcncttcnctgctcnctccttagggaacaagctcgccctcaccatccgacggggcccaggcgacgacgatgaatgtagtattanctacgtcgttccgttctttagttcgggtgggtcgtggacgttggtttggggtcggttcgggacgggtacggaccgtaaacggtccgtaccgttaccgtacggtccgacgtacccgg

SEQ ID NO: 148836 - DNA, 612 bp, Homo sapiens
  misc_feature: GYAE6OF02JP8MF.15.34.D01.1.454.CMB.1.raw
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagtctacgtagccacgaccggtgctcgatttagatcgtctgtgttgggtttgggggtaaaagggcccgtgaggaaaacaaaccccagactgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggtacagtcacgactcacttgtgccttgaggtctggctcagtctctacttctactacgcccgctcggtacccgcacgaccccnggcccagccctccacgcacgctcatctacatacaacnctacgctccttccggggtcctgatccgtcttctcgtcggcctccacttccgtagggaaccaaagtcctcgtcccctacaccacgtccggaccggggcccagccgaacgacgactgaattgtatacttactccgacttagccgtttacctttagcgggtcggggcttaggccgttaggtttcggggtgttccggggcggtacgggaacccgtaacgttccggacccgtttaccggacggttccgacggtaccccgg

SEQ ID NO: 148837 - DNA, 554 bp, Homo sapiens
  misc_feature: GYAE6OF02I2SAB.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtcctgatcgcttctctggctccatccttggaacaagctgccctcaccatcgacggggccaggcagacgatgaatgtagattatcactgcgttcctttagtggtgggcgtggctagtttggggtgttcgggcggagggaaccaagtcgtaccgtccgtaggtcacgaccgaggcctcgcccctggtaccacgtcctcgttccccacccttccgtccgtacctaccggtacgaccgtggacggcggtaccg

SEQ ID NO: 148838 - DNA, 545 bp, Homo sapiens
  misc_feature: GYAE6OF02HAK4M.15.34.D01.1.454.CMB.1.raw
  modified_base (363)..(363): a, c, t, g, unknown or other
  misc_feature (363)..(363): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctcggtaccggcacgaccccaggccacgcctccacgcacgctcatctacagtacaaacactcgctcgttccgggtcctgactcgcttctctgctccatccgttagggaacaaagctcgccctcaccancgtacggggccaggcagacgatgaatgtgattatcactgcgttctttagtggtcgggcgtggctagtttgggtgttcgggcggacgggaccaaacgtcgaccgtcgtaggtcacgccaaggctccgcccctgtcacgtctccgttccctaccctcctcgctacgtacgtactgacgcggtcg

SEQ ID NO: 148839 - DNA, 587 bp, Homo sapiens
  misc_feature: GYAE6OF02GS0AT.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctctccgggtccctgactcgtcttctctcggtctccatccgttaggaacaaagctcgccctacaccacgtccgaccgggggcccacggcagacgatagaatgtagtattatctactgtccgttctttacgtggtcggggcggtcggtcgttggtttggggttcggttcgggcgggtaacgggtaccgaacgtacggtaccggttacccgttacgggtacctacggtaccccgg

SEQ ID NO: 148840 - DNA, 569 bp, Homo sapiens
  misc_feature: GYAE6OF02JFATS.15.34.D01.1.454.CMB.1.raw
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttcnctgctcntcctggaacaagctgccctcaccatccgacggggccacggcagacgatgaatgtgtattatcactggtcgttctttagtggtgggcgtggctaggtttgggtgttcgggcggacgggacctaaacgtcgaccgtcgtacggtcgacgaccgacggtccgtccgcccccgtcgtcctacgttccgtaccgttccccgtccctcccgtccgtaccgtaccgtagaccgtcggacggccggtcgg

SEQ ID NO: 148841 - DNA, 566 bp, Homo sapiens
  misc_feature: GYAE6OF02GXM0R.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcgttccggggtccctgatcgcttctctggctccatccttgggaacaagctgccctcaccatcgaccggggcccaggcagacgatgaatgtgattatcactgtcgttcctttagtgtggggcgtggctagtttgggtgttcgggcggaggaccaaacgtcgaccgtcgtaggtcacgccgaagccgtcgcccccgtcggtccaccgtccgttccgttccccacccttcccgttccgccttaccggtacgaccgtacggacggcggtaccg

SEQ ID NO: 148842 - DNA, 593 bp, Homo sapiens
  misc_feature: GYAE6OF02JYOT0.15.34.D01.1.454.CMB.1.raw
  modified_base (206)..(206): a, c, t, g, unknown or other
  misc_feature (206)..(206): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
tcagtctacgtagccacgaccggtgctcgatttagatcgtctgtgttgggtttgggaaccgtatgaacattctgtaggggcactgtcttctcctcggactccttgcttatggatcaggagtggattctcagactgtggtgacccaggagccatcgttctcagtgtcccctggagggacagtcacactcacttgtgccttgaggtcnggctcagtctctacttctaactacgccgcctggtaccgcacgaccccaggccagcctccacgcacgctcactctacagtacaacactcgctcgtccgggtcctgatcgcttctctggctccatcctgggaacaaacgctcgcctcaccatcgacggggccaggcagacgancgactgtgattntacactggcttacgtttacgtgggtcgggtgtcgggtcttaacggtttggggtacgttccgggacgggacgggtaaccgtaaacggttccgacccggttcgtaacgggttcaacgtacccgaaggtccgtccgaccccgttcggtctaccgtcgttccgtcccgaccttccggtactccgtacgacgttcgacgcggcgtccgg

SEQ ID NO: 148843 - DNA, 527 bp, Homo sapiens
  misc_feature: GYAE6OF02FIGZA.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaacgtgaccgtctaggtcacgcccaaggctcgcccctcgtcactctcgttcccgccctccctcgctacgtacgactgagcggtcg

SEQ ID NO: 148844 - DNA, 581 bp, Homo sapiens
  misc_feature: GYAE6OF02G5P9D.15.34.D01.1.454.CMB.1.raw
  modified_base (450)..(450): a, c, t, g, unknown or other
  misc_feature (450)..(450): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccaggccagcctccacgcacgctcatctacagtacaaacactcgcttcgttcccggggtccctgactcgcttctctgtcctcatccttagggaacaaagctcgccctcaccatccggaccggggccaggcacgacgatnaagtgtagtattactcactcgtcgttcctttagtgggtgggtcggttggcgttaggtttcgggtaggttcgggacgggtaacggacccgtaaacggtcgacccggttacgtacggttaccgacgtacccgg

SEQ ID NO: 148845 - DNA, 548 bp, Homo sapiens
  misc_feature: GYAE6OF02FIAFY.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgacccccaggccagcctccacgcacgctcatctacagtacaaacactcgctcttccggggtcctgatcgcttctctggctccatccttggaacaaagctcgccctcaccatcgacgggggccaggcagacgatgaatgtagtattatcactgtcgttctttagtggtggggcgtggtctagtttgggtcgttcgggcggacgggacaacgtcgtaccgtcgtaggtcacgccagcctcgcccctcgcacgtctccgttcccgccctcctccgtactacgtacgactcggacggcggtacg

SEQ ID NO: 148846 - DNA, 623 bp, Homo sapiens
  misc_feature: GYAE6OF02HPK4P.15.34.D01.1.454.CMB.1.raw
  modified_base (314)..(314): a, c, t, g, unknown or other
  misc_feature (314)..(314): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgccttgaggtctggctcagtctctacttctaactacgccgcctggtaccggcacgaccccnggccagccctccacgccacgctacactcctacaacgtaacaaactacctcgccttccggttcccggggtccctggtactccgtctttctctcggcctcctactccgttagggaacaaacgtctcgccctcacccagtccggacccggggaccacggcgaacgaccgagtagaacgtgtagtaacttactacgactcgtccgtttccgtttagtgggttacggggtcgtggtcgttaggtttcgggtcggttcgggcgggtacggaaccgtaacggtccggaccgttccgtacggtacgaccgtacccgg

SEQ ID NO: 148847 - DNA, 682 bp, Homo sapiens
  misc_feature: GYAE6OF02JKN1V.15.34.D01.1.454.CMB.1.raw
  modified_base (312)..(312): a, c, t, g, unknown or other
  misc_feature (312)..(312): n is a, c, g, or t
  modified_base (623)..(623): a, c, t, g, unknown or other
  misc_feature (623)..(623): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgagtctggctcagtctctacttctaactacgccgcctggtaccggcacgaccccaggccagcctccacgcacgctcatctacacgtacaaacactcgcttcgtccggggtccngatcgcttactctggcctcactcccgttggaaacaagctcgccctacaccactcggaccgggggcccaggccaggacgagtacgaaagttgtacgtaatttactactacgtcggtccgtttaccgttttagtcgggggttcggggcggttgggtccttagggttttggggggtacgtttcggggaccgggaacggggaaccctaaacggttcgggacccgtttccgttaacgggtccaacggtaccccgaacgggtccctaccgggtcccccgttcgggttacccaccgtttcccgttacccgtttccccnccccgtttccgttaccggacccgtttacggaccggtacgtccgggtacggccgggtccg

SEQ ID NO: 148848 - DNA, 588 bp, Homo sapiens
  misc_feature: GYAE6OF02HF546.15.34.D01.1.454.CMB.1.raw
  modified_base (450)..(450): a, c, t, g, unknown or other
  misc_feature (450)..(450): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaacctacgccgcctcggtaccggcacgaccccaggccagcctccacgcacgctcatctacagtacaaacactcgctcgttccgggtccctgactcgtcttctcgtcggctccactccgttagggaacaaagctcgccctcaccatccgaccggggccaggcagacganagatgtagtattatctacgtgtccgttctttagtcggtggggtccgtggtcgttacggtttgggtcggttcgggggaccgggtacgggtaacccgtaacggtcggtaacccggtcggtaacggtccgacgtaccccgg

SEQ ID NO: 148849 - DNA, 607 bp, Homo sapiens
  misc_feature: GYAE6OF02H0JMV.15.34.D01.1.454.CMB.1.raw
  modified_base (383)..(383): a, c, t, g, unknown or other
  misc_feature (383)..(383): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctgggagggacagtcacactcacttgtgccttgagtctggctcagtctctacttctaactacgccgcctggtaccggcacgaccccaggccacgcctccacgcacgctcatctacagtaacaaacactcgctcgttccgggtcctgactcgtcttcnctcggctcgactcgttacggaacaaagctacgccctacaccactccgaccggggcccaggcagacgatgaacgtgtagtattacgtctacgtcgcgtttcctttagtcgggtacggggtccgtgggacgttacggttttggggttcggtttcgggaccgggtaacgggaaccgtaaaccgttccggaacccgttaccggtacggttaccgaccggtaaccccgg

SEQ ID NO: 148850 - DNA, 625 bp, Homo sapiens
  misc_feature: GYAE6OF02GSNCL.15.34.D01.1.454.CMB.1.raw
  modified_base (417)..(417): a, c, t, g, unknown or other
  misc_feature (417)..(417): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttggaggtctggctcagtctctacttctaactacgccgcctggtaccggcacgaccccaggccacgcctccacgcacgctcatcacagtacaacactcgctcgtccgggtcctgatcgcttctctggctcctactccgttaggaacaagctcgccctcaccnctccgaccggggcccaggcagacgatgaagtgtagtatttacactacgtcgtccgttaccgttttacggtggtacgggggtcgtacgggtcgttaacgggtttttgggggtcgggtttccggggtaccgggggtaacggggtaaaccccgtaacggttaccgggttaccccgttaccggtaacgggtcccgtaaccggtaaccccggg

SEQ ID NO: 148851 - DNA, 612 bp, Homo sapiens
  misc_feature: GYAE6OF02IULSH.15.34.D01.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtnccttgaggtcnggctcagtctctacttctaactacgccgcctggtaccgcaggaccccaggccacgcctccacgcacgctcactctacagtacaaacactcgactcgtccggtcctgactcgctttctcgtcggccttccattccgttacggaactaaagcctcgccctcaccagtcaccggggggcccacgggcacgacgactagaagtgtgtacttactcactgtcgtactttagtggtcgggtcgtggcgtagtttgggttcggtcgggtcggacgggactaacgtcggtaccgtcgttacggcgaacgtccgaacggtccgtccgccccgttcggtcctaccgtcctttccgtcccctacccgtcccgtccgtaccgttacggtaccgtacgtacggtacgggccggtaccgg

SEQ ID NO: 148852 - DNA, 583 bp, Homo sapiens
  misc_feature: GYAE6OF02GA5AA.15.34.D01.1.454.CMB.1.raw
  modified_base (402)..(402): a, c, t, g, unknown or other
  misc_feature (402)..(402): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactccgctccgttccggggtccctgactcgcttctctggcctccatccgttaggaacaacgctcgccctcaccatcgacggggccaggcagacgagtagaatgtagattanctagtcgtcgttctttagtggtgggtcgtggctagtttcgggtggttcgggcgggaacggacgaacgtcgaccggtcgtacggtcacgacccgaaggcctacgtccccgtcggtccaccgttctccgttccccgtcccctcgtccgtccgttaccggtacgaccgtggacggtccggtcgg

SEQ ID NO: 148853 - DNA, 716 bp, Homo sapiens
  misc_feature: GYAE6OF02ICH2G.15.34.D01.1.454.CMB.1.raw
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagttcgtcccctgggagggacagtcacactcacttgtgccttgaggtctggctcagtctctacttcctaactacgccgccgtggtaccgcacgaccccaggccacgcctccacgcacgcncatctacacgtaacaaacnctcgctcgttccgggtcctgactcgtcttcgtcgtcggccttccgtattccggttagggaaaccaaacgtccgttaccgccccttaccacgtactaccgggacccgggggtcccaaggtcaacgggaaccgtagtaacgtaacgttgttagtaactttacgtacctaccgttcggttccgttttacccgtttaggttcggggttaccgggggccgtttacggggtaccgttttaggggtttttacgggggttccgggttttaccgggggaccgggggttaaaccggtaaaccccgttaacggttcccgggtaaccccgtttacccgggttaacggtaccccggaccggtaacccccggg

SEQ ID NO: 148854 - DNA, 658 bp, Homo sapiens
  misc_feature: GYAE6OF02FVUB5.15.34.D01.1.454.CMB.1.raw
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgacccccaggccagccctccaccgcacgctcatcacagtaacaaacactcgctcgttcccggggtcctgactcgcttctctgctccntccgtaggaacaagctgcccncaccatccgacggggcccaggcacgacgatagaatgtagtattatctactgtccgttaccttttagtcgggtaggggcggttggtacgttaggttttgggttggtttccggggacggggtaacgggaccgtaaacggtccggtacccgttaccggtacggtaccaccgacccgtaacggtcctacccggtcccccgttccggtccctaccgtttcctaccggtttacccccctaccccttacccgttcccgtaccgttaacccgttaacgtacccgttacgggtaccggtccgggtaccggg

SEQ ID NO: 148855 - DNA, 641 bp, Homo sapiens
  misc_feature: GYAE6OF02ILGR2.15.34.D01.1.454.CMB.1.raw
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (391)..(391): a, c, t, g, unknown or other
  misc_feature (391)..(391): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccgaggagccatcgttctcagtcgtccccgtgggagggacagtcacacctcacttgtcgtccttgaggtctggctcagtctctacttctaactacgccgcctggtaccggcacgaccccgaggccagccctcgcgcncgctcatctanacgtacaaactactcgctcgtcccgggtcctggactcgcttcncgtggcctcagttccgtagggaaacaagtcctcgccctcacctagtcccggaccggggcccaggacaacggacgagtgaacgttggtagtaacttactaccgtacgttcgtaccgtttcgtttaggtacggggttgggccggttgggtaccgtttagggttttcggggttacgggttccgggaaccggggtagggtaaccctaaacggtcggtaacccggttacggacggttacccgacgtaaccccggg

SEQ ID NO: 148856 - DNA, 688 bp, Homo sapiens
  misc_feature: GYAE6OF02IBPS8.15.34.D01.1.454.CMB.1.raw
  modified_base (363)..(363): a, c, t, g, unknown or other
  misc_feature (363)..(363): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtccctggagggacagtcacactcacttgtgccttgaggtctggctcagtctctacttctaactacgcccgctcggtaccgcacgaccccagggccacgcctccgacgccacgctcatctacagtacaaacactcgctcgttccgggtcctgctcgcttctcgtgctccatccgttaggaacaacgtctcgcctcaccntcgcgggccaggcagacgatgaactgtagattactcgatacgtcgttacgtttagtggtcggggtcggttcggtcgttagggttttcggggtacgggtttccgggtacggggtaaccggtaaaccgtaaaccggtacgggtaccccgtaccgggttacggtaaccgtaccggtaacccggtaaacggtcccgttcccggtcccccgttcggttcccgttaccgttcccggtttaccccgttcccccggttccctttccccgtacccggttacccggttaaccggttaaccgtacggttacggggtaccgggtcgggtaacccggg

SEQ ID NO: 148857 - DNA, 608 bp, Homo sapiens
  misc_feature: GYAE6OF02I3X0L.15.34.D01.1.454.CMB.1.raw
  modified_base (408)..(408): a, c, t, g, unknown or other
  misc_feature (408)..(408): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctcacgcacgctcatctacagtacaaacactcgactcttccggggtcctgactcgcttctcgtggcctccattccgttggaacaaagtcncgccctcaccactccgaccggggccaggcacgacgatcgaatgtgtagttatccgtatcgacttccgttttgtacgggtggggtacgttcggacgttaggttttcgggttcgggtttccggggacgggtaaccgggtaacccgtaaaccggttcggtacccgttaccggtttaacgggtccgtaaccgggtaaccccggg

SEQ ID NO: 148858 - DNA, 685 bp, Homo sapiens
  misc_feature: GYAE6OF02JNVDR.15.34.D01.1.454.CMB.1.raw
  modified_base (351)..(351): a, c, t, g, unknown or other
  misc_feature (351)..(351): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtcgccttgagtctggctcagtctctacttctaactcgccgcctggtaccgcacgccccgaggccagccctccacgccacgctcactctacagtacaaacnctcgctcgttccgggcctgactccgactttctcgtcggtcctacctattcccgttacgggaactaaacgtccgtccgtccctaccgacctacgtcccggaccgggggtaccctacggaccgacggaaccgtaagtacggtaaccgttggtacgtaactttaacgtccgtaacgttccgtaccgtttacccgtttagttacggggttcgggtccggttagggtaccgttagggtttggggttacggtttaccggggaccgggttaccggaacccggttaaccggttacgggtaaccccggttccggttaacgggtaccgtaccggtaaccccggg

SEQ ID NO: 148859 - DNA, 625 bp, Homo sapiens
  misc_feature: GYAE6OF02FMODT.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctcttacttctaactacgccgcctggtaccggcacgaccccaggccagcctccacgcacgctcatctacagtacaaacactcgctccgttccggggtccctgactcgcttctctggctccatccgttaggaacaagctcgccctcaccatcgacggggccaggcagacgatagaatgtagtattatcacgtgtacgttcctttagtggtcggggcgttggtctagtttgggtcggttcgggcgggtaacgggaacctaacgtcggtacccggttcgtaacgggtcgaaccgacccgaacggtcctccggtcccccgttcgggtacctaccgttccgttcccggttacccccggcccttacccgtccgtaccgttacggtaaccggtccgtacgggaccggtcgggtaccgg

SEQ ID NO: 148860 - DNA, 612 bp, Homo sapiens
  misc_feature: GYAE6OF02GF617.15.34.D01.1.454.CMB.1.raw
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
tcagtctacgtagccacgaccggtgctcgatttagatcgtctgtggtggaatctggggggaggcttggtccagcctgggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccattcactatcctccagagaacaacgccaaagaatctagtgtatttgacaaatgaacngcctgagagccgacgacacggctgtgtattctgtgcgggngggccggagtggtagttggattacgtttcgtgggccgacggggtccctggtccaccgttctccgtcacgtccctaccaaccgaacgggcccagtccggtcccttccccgtcggcccgtcccgtcgccctcgacggacgccaccgtccgacgacgccgacacggcccggcccgtcgggcctcggcccgtggtaccgaacggtaccttaccgttccgtaccgttaaccgtacgtaccgtaggtacggccgggtcgtacggaccgaacgggcgtacgagtacgg

SEQ ID NO: 148861 - DNA, 630 bp, Homo sapiens
  misc_feature: GYAE6OF02JR1DY.15.34.D01.1.454.CMB.1.raw
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
  modified_base (436)..(436): a, c, t, g, unknown or other
  misc_feature (436)..(436): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggacgccatcgttctcagtcgtccccgtgggacggacagtcaacactcacgttgtgccttgaggtctggacctnagtctctactctactacgccgctggtaccgcacgaccccaggcccagccctaccncgcncgctcnctctacagtaaccaaactcncgctaccgtccggggtaccctgacttcgctttcnctggcctccgattccgtagggaaacacgtctacgccctanacctacgtccggaaccggggtcccaaggtccagaccgaagttacgaagtcgtaggtacttacgcgtaacgtcgtccgttaacctttgtcggggtccggtagtgtcgtttacgggtttgggtcggttacggcggggtaaccggtaaccgttacgtccgggttaccgtacccggttaggtccgacggtacccccgg

SEQ ID NO: 148862 - DNA, 671 bp, Homo sapiens
  misc_feature: GYAE6OF02JYTNO.15.34.D01.1.454.CMB.1.raw
  modified_base (444)..(444): a, c, t, g, unknown or other
  misc_feature (444)..(444): n is a, c, g, or t
tcagtctacgtagccacgaccggtgctcgatttagatcgtctgtgttgggtttgggggaaaaggccctgaggaaacaaacccagctgggaagcctgagaacacttagccttcatgagtgtcccaccatggcctggatgatgcttctcctcggactccttgcttatggatcaggagtggattctcagactgtggtgacccaggagccatcgttctcagtgtcccctggagggacagtcacgactcacttgtgccttgaggtctggctcagtctctacttctaactacgccgcctggtacccggcacggaccccaggccacgcctccacggcacgctcatctacagtacaacactcgactcgtccgggtacctgactcgcttctcgtcgctcctagtccttgggaactaagcctagcccttacacccacgtccgaccgggggcccncgggacctacgggacccgaagtcggtaaagttcggtagtacgttaacgttcgtaaccgtttagtcctttcccgttttaagttcggggttacgggggtcggttacgggtcgtttaacgggtttcggggttcggtttaccgggggtacgggtaaccggggtacccgtaaaccggttccgggtaacccggttcccggtaacggggtttacccgaccgggtaacccccggg

SEQ ID NO: 148863 - DNA, 664 bp, Homo sapiens
  misc_feature: GYAE6OF02I7WD9.15.34.D01.1.454.CMB.1.raw
  modified_base (275)..(275): a, c, t, g, unknown or other
  misc_feature (275)..(275): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccgtggagggacagtcacactcacttgtcgtccttgaggtcgtggctcgngtctcttacttactaactaccgcccgccgtcggtacccggcaccgaccccgaggccacgccctccacgcacgctacattcacacgtaaccaaacactccgtccttaccggttcccggggtaccctgactcgtccttctcgtcggcctcacttccgtaggaaaccagcctcgccctacaccctacgtacccgggacccgggggcccgtacggacgaacggacgacgtacgtaagttggtaacgtacttactcgtaccttcggtccttttaccgtttaggtgggttcggggcgttacggtcggttacgggtttggggttcggttacggggtacgggaacggtaacccgtaacggttcggtacccgtacggtacggtacggaccgtacccgg

SEQ ID NO: 148864 - DNA, 708 bp, Homo sapiens
  misc_feature: GYAE6OF02I8L3X.15.34.D01.1.454.CMB.1.raw
  modified_base (217)..(217): a, c, t, g, unknown or other
  misc_feature (217)..(217): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttcncagtcgtcccgtggaggacagtcacactcacttgtcgccttgacggtctgctcagtctctacttctaactcgccnctggtaccgcacgaccccgaggccacgcctccgacgcacgctcactcacacgtaacaaacnctccgcttccggttcccggggtcctgactccgtctttcgccgttcggtacctccgtacttcccggttacgggtaaaccaaagtccccgtcgacccctaccaccctacggtacccggaccgggggaccccagggtaccaacggaccgtaacgtacggtaaggtcgttaggtaaacgtttacgtacctacggttcgttaccgttttaccgttttaggttcgggttcggggtcggtcggttcggtttacgggttttacgggttcgggtttaccggggtaaccgggtaaccgggtaacccgttaaacggtccggttaacccggttaccggttaaccggttaccggaccgtaaccccggg

SEQ ID NO: 148865 - DNA, 604 bp, Homo sapiens
  misc_feature: GYAE6OF02JYFH5.15.34.D01.1.454.CMB.1.raw
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (366)..(366): a, c, t, g, unknown or other
  misc_feature (366)..(366): n is a, c, g, or t
  modified_base (468)..(468): a, c, t, g, unknown or other
  misc_feature (468)..(468): n is a, c, g, or t
  modified_base (492)..(492): a, c, t, g, unknown or other
  misc_feature (492)..(492): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgaccgaggacgcatcgttctcagtcgtccctggagggacnggtcacactcacttgtgcttgaggtctggctcngtctctacttacctaacttaccgccgtccgtcggtacccggcaccgacccgacggccagccctccacgccacgcctcattcactagtaaccaaacnctacgtcttccgtaccggggtcctaggtctcgtcttctcgtgcctctctcgtaggaccaagctcgcctacacctacgtcggaccgggccacggcacggcganagtaacgtgtagtacttactactntcggtacttccgttggtggtggtcggtacgtcgttagggttgggttcggtccggggtcgggtaacggaccgtaacgtacggtacgtaccggtacggtacggtacccgaccgg

SEQ ID NO: 148866 - DNA, 598 bp, Homo sapiens
  misc_feature: GYAE6OF02HQ5FT.15.34.D01.1.454.CMB.1.raw
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
  modified_base (387)..(387): a, c, t, g, unknown or other
  misc_feature (387)..(387): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatcacagtacaaacactcnctcttccggggtccctgactcgcttctctgctcntccttggaacaagctcgccctcaccatacgaccgggggcccaggcagacgatagatggntattatcacgtgcgttcttagtggtaggggcgtggtcgtagtttcggggttgttcggggacggacgggaaccgtaaacggtacgtacccgttaccgtacggtacgaccgtacccgaaggccgtccgccccgttcggtcctacgtcttcccgttccccaccccgttccctacgtccgttaaccgtacgtacgtcggacggtccgggtaccgg

SEQ ID NO: 148867 - DNA, 625 bp, Homo sapiens
  misc_feature: GYAE6OF02GA8AZ.15.34.D01.1.454.CMB.1.raw
  modified_base (348)..(348): a, c, t, g, unknown or other
  misc_feature (348)..(348): n is a, c, g, or t
tcagtctacgtagccacgaccggtgctcgatttagatcgtctgtgttgggtttgggggaaaagggcccggtgaggaaaacaaaccccagctgggaagcctggagaacacttagccttcatgagtgtccccaccatggcctggatgatgcttctcctcggactccttgcttatggatcaggagtggattctcagacctgtggtgacccaggacgccatcgttctcagtcgtcccctggagggacaggtcacactcacttgtgtccttagaggtctggctctgtctctacttctaactacgccgcctggtaccgcacgacccaggccagcctcacgcacgctcatctacngtacaaacactcgactccgttccggggtccctgactcgcttctctcggctcactccgttagggaacaaagctacgcccgtacacctacgtccgaccgggggtacccagggccacggacgtagtagactgtagtaattagtcgtacgttcgtcgttacgttaggtgggtcggggtcgtacggtcgttaggtttcggggtcgtttaccggggcgggtaacgggtacccgtaacgttcccgggtaccggttacccgtacgggttccgaccggtaccccgg

SEQ ID NO: 148868 - DNA, 796 bp, Homo sapiens
  misc_feature: GYAE6OF02FQFPA.15.34.D01.1.454.CMB.1.raw
  modified_base (186)..(186): a, c, t, g, unknown or other
  misc_feature (186)..(186): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattcncagactggtggtcgacccaggacgccattcgttctcgagtcgtccccgtgggacggactagtccacactctacttgtcgcgttggaggttcctggcctatacgtcttacttacttacctaacctaccgcccgtccgtacgggtacccgaccacccggtacccgacggcccacggccctaccgaccggccaccgtcctctaacgttacctaacctacgtaaaccaaacctccgtaccggttcccgttcccggtttacccgggtccctggtaccttccgttccttcgtccgttcggtccctaccgtacgtttcccggtaacggtaaacccaacggttccctacggtacccctacgtaacccgtacggtaccccggggaaccgggtcccgaaggtacccgaacggtaactcggtaacgtaaggttcgtaagttacttaccggacgttccgtaccgggttacggtttaccgttagggttaccgggtccgggtagggttccgttaccgggtttagggtttcccggggacgggtttaccgggaaccgggtaacccgttaaccggtacgttacccgggtacccggttaaccgcgggtaacccgcccggtaacccggg

SEQ ID NO: 148869 - DNA, 559 bp, Homo sapiens
  misc_feature: GYAE6OF02G6IZ1.15.34.D01.1.454.CMB.1.raw
  modified_base (349)..(349): a, c, t, g, unknown or other
  misc_feature (349)..(349): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (449)..(449): a, c, t, g, unknown or other
  misc_feature (449)..(449): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggaggacagtcacactcacttgtgccttgaggtctggctcagtctctacttctaactacgccgcctggtaccggcacgaccccaggccagcctcacgcacgctcatctacagtaccaaacncncgctcgttccggggtccctggactcgcttcnctggctccatccgtaggaacaaagctgccctcaccatcgaccggggccacggcagacgatagatgtntaattactcactcgtcttccttagtggtgggcgtggtctaggtttgggtgttcgggcgggtacggaacctaacgtcggtacccgtacggtacggtaccgtacgaccccgg

SEQ ID NO: 148870 - DNA, 812 bp, Homo sapiens
  misc_feature: GYAE6OF02GGM9K.15.34.D01.1.454.CMB.1.raw
tcagtctacgtagccacgaccggtgctcgatttagatcgtctgtgttgggtttgggggaaaaggccctgaggaaaacaaacccccagctgggaagcctgagaacacttagccttcatgagtgtcccaccatggcctggatgatgcttctcctcggactccgttgcttatggatcaggacgtggtacttcgtcagtacgtgtggtgacccgaggacgccatcgttctcagtcgtccccgtaggacgggacacggtcaaccactacctactttagtcgtccctttaggaggtactcggacctcgtacgtccgtccttaacttacctaaacctaccgaccgccgtacggtacccgacctaacgaccccgacgccgacgccctccgtaccgccgacgtcgtacctactacctaacacgtaacaaaccacctaccgtcgttccgtttacccggggtccctacgtactaccgtcctttccttaccgtcggtccttaccgtaccgttaccggtttacggaaacgtaacgaccgtaccgacccgttaccaacccgtacgtacccgggtaacccggggacccgtaacggtacccgtaacgggaaccgaagtacgtaaacgttacgttaacgtaacttttacgtaccgtaacgttccggttaccgtttaccgttttaacggttgggttacgggggttcggtacgggttacgttaagggttttcggggtttacgggttccggggtacgggtaaccgggaaaccgttaaccggttaccggtaacccggttccggtttaaccggttccggtaacccgtaccccgg

SEQ ID NO: 148871 - DNA, 789 bp, Homo sapiens
  misc_feature: GYAE6OF02HRKN1.15.34.D01.1.454.CMB.1.raw
  modified_base (197)..(197): a, c, t, g, unknown or other
  misc_feature (197)..(197): n is a, c, g, or t
  modified_base (422)..(422): a, c, t, g, unknown or other
  misc_feature (422)..(422): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcaacactcacttgtnccttgaggttctggctcagtctctacttctaaccgtacgcccgtccgtcgggtaccgcacgacccgacggaccacgccctaccacgtaccacgctcacttacctacgagtaaaccaaacctacctaccgtccttaccggttccggggttcccctggacttccgtctttctcgtcgcctcctacttaccggttagggaaacctaacgctaccgtaccctccaaccncgtacccggacccggggccaggaccgacggaacgtagtaggaacgttgtagttattacacgtacgtcggttccgtttacgtttacggtcgggttacggggtcgtgggttacgtttagggttttcgggtccgggttacggggtacgggtaaccggtaccgtaaaccgggttccggtacccggttaccggttacgggtaaccaccgggttaacccgaacggtacccgtccccggttacccggttcccggttaaccgaccggtttcccggttacccggtttccccccgaccggtttaccccgtacccggttaacggttaacccgggtacgtacccggggttaacggtacccggggtcgggtaacccgggg

SEQ ID NO: 148872 - DNA, 592 bp, Homo sapiens
  misc_feature: GYAE6OF02FK50W.15.34.D01.1.454.CMB.1.raw
  modified_base (408)..(408): a, c, t, g, unknown or other
  misc_feature (408)..(408): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccgcacgaccccaggccagcctccacgcacgctcatctacagtaacaacactcgcttccgttccggggtcctgactcggcttcgtcgtggctccattccgttaggaactaacgctcgtccctcaccatccggaccggggcccaggcagacgatagaatgtgtattcnctatcgtcgttctttggtggtcgggcgtggcgtggtttggtgttcgggcggtacggacaacgtcgaccgtctaggtcgacgaccgacggcgtcccgcccgtacggtccaccgttccgtcccgttccccgtacccttcccgtacgttccgtacggtacgtaccggtacggcgggtccgggtacgg

SEQ ID NO: 148873 - DNA, 725 bp, Homo sapiens
  misc_feature: GYAE6OF02GETNJ.15.34.D01.1.454.CMB.1.raw
  modified_base (221)..(221): a, c, t, g, unknown or other
  misc_feature (221)..(221): n is a, c, g, or t
  modified_base (373)..(373): a, c, t, g, unknown or other
  misc_feature (373)..(373): n is a, c, g, or t
tcagtctacgtagccacgaccggtgctcgatttagatcgtctgtgttgggtttggggggaaaagggccctgaggaaaacaaaccccagctgggaagcctgagaacacttagccttcatgagtgtccccaccatggcctggatgatgctctcctcggactccttgcttatggatcaggagtggattctcagactgtggtgacccaggagccatcgttctacngtcgtccccgtagggagggacaggtcaacactctacttgtcgtctagaggtctggctcagtctcttacttactaactacgccgtctcgggtaccgcacgaccccaggaccacgccctaccgacgcaccgcttcactctaacagtaacaaacnctccgtctccggttacccgggtccctaggtactccgtctttcctacggtcggaccttaccacgttaccggtttaacgggaaacctaaaggtcccttcggacccccttactaacccgtaaccggttccgggaacccgggggacccgaggacccgaaacggtaaccggtaagtaacgtaagtcggtaacggtaatttaccgtaacgtaccgttccgttccggttaaccttttggcgggttacggggccgttggtacgttaggtttcgggggtcggttacggggccgggtaaacgggtaacccaacggttaccggtaacccgttaccgggtacggtcccgtaaccggtaccccgg

SEQ ID NO: 148874 - DNA, 647 bp, Homo sapiens
  misc_feature: GYAE6OF02HBYWY.15.34.D01.1.454.CMB.1.raw
  modified_base (359)..(359): a, c, t, g, unknown or other
  misc_feature (359)..(359): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggtacagtcacactcacttgtgccttgaggtctggctcagtctctacttctaactacgccgactggtaccgcacgaccccaggccagcctccacgcacgctcatctacagtacaaacactcgctcgttaccggggtccctgatcgcttcgtctaggcctccgacttcgtagggaacaagtcctcncccgtacaaccagtccggaccggggcccaggcacgaacgatagaacgttgtagtattacgtcgtaacgtcgttcttactttggtacggtaggggcgttggcttaggtttggggtacgttggggtaccggacgggtaacctaacgttccggtacccgttcgtaccggtcaaccggaccgtaacggccctccggtccccctcggtacgtacccttcgttacccgttaccccacccgttcccgtaaccgtccgttaaccgggtacgtccgtacggacgggccggttaccgg

SEQ ID NO: 148875 - DNA, 641 bp, Homo sapiens
  misc_feature: GYAE6OF02F1J1I.15.34.D01.1.454.CMB.1.raw
  modified_base (275)..(275): a, c, t, g, unknown or other
  misc_feature (275)..(275): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagacccccaggccagcctccacgcacgcncatctacagtacaaacactcgactcgttccggggtccctgatcgcttctctggctccacttccgttgggaaacaaagtctacgcccgtacacccacgtcgaccgggggcccaggcaggaccgatagtaatgtagtattatccattcgtcgtacctttagtgggtgggtcgtggtcgtagtttgggtcggttcgggacggtacgggacctaaacgtcgtaccggtcgtagggtccgtaacggcccgtaacgggccttaccgaccccgttcgggtaacctaccggttccttccggttacccccgtccccgttaccgttacccggtacgttaccggttacgtaccgtacggtaccggtcgggtaccggg

SEQ ID NO: 148876 - DNA, 654 bp, Homo sapiens
  misc_feature: GYAE6OF02HGQ0I.15.34.D01.1.454.CMB.1.raw
  modified_base (294)..(294): a, c, t, g, unknown or other
  misc_feature (294)..(294): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtccctgggaggacagtcacactcacttgtgccttgaggtctggctcagtctctacttctaacctcgccgcctggtaccggcagaccccaggcctacgcctccacgcacgctcatctacagtaaccaaanacctcgtcttaccgtcccggggttccctgacgttccgccttcctcgtcggcctccgtacttccgtaggggaaccaaagcctaccgcccttacaccagtacgaccggggccacggccgtaagaccggntacgtaatgggtactnttaaactccagtgtcgttcctttaaggtcggtaggggtccgtggtccgttagtttcgggttggtcgggacgggacggtaacctaaacgtcggaccgttccgtaacggtacacgcccgttaaaggccgttccgtaccccggtacggtcctacgccgtttaccgtcccctaaccttccccgacgttcgtaccggtcgtacctaggtaccggcggtccgg

SEQ ID NO: 148877 - DNA, 716 bp, Homo sapiens
  misc_feature: GYAE6OF02HN6H8.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgaccaggagccatcgttctcacgtcgtcccgtagggagggacacgtacacgactctacttggtgtccgttgaggtcgtggctcagtctctactctaactcgccgcgtcggtaccgcacgaccccaggcccacgcctccgaccgcgaccgctcactactacgactaacgaactacctcgtcctccgtttccgggtcctcgtaacgtcgtactttcgtacgtcggtacctcctagttccggtaacggaacaacggtctccgtaccctcgaacctcgtacccgggacgggggtacccgaggaccgacggaccgagtacggaacgttaggtacgtacttacgtcgtacgttcggtacctttccggtttaaggtcggggttacggggtcgggttcgggtacgttttaggggtttcgggttaccggggtttcgggaccgggggttaaccggggtaacccgtaaccgggtttaacgggtacccgggtttaacccggtacgggttcccggtaaccggtaaccccggg

SEQ ID NO: 148878 - DNA, 626 bp, Homo sapiens
  misc_feature: GYAE6OF02JN26P.15.34.D01.1.454.CMB.1.raw
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (420)..(420): a, c, t, g, unknown or other
  misc_feature (420)..(420): n is a, c, g, or t
tcagtctacgtagccacgaccggtgctcgatttagatcgtctgtgttgggtttgggggaaaagggacccgtgaggaaaacaaaccccaagctgggaagcctgagaacacttagccttcatgagtgtcccaccatggcctggatgatgcttctcctcggactccttgcttatggatcaggagtggattctcagactgtgggtgacccagggacgcctatccgttctcagtgtcccctgggacgggacagtcacactcacttgtcgccttggaggtctcggctccagttccgtctacctttctaactacgcccgccttcggtacccggcacgaccccctaggccacggccctacaccgcaccgctacgctctacagtaacaacncncgtctccgttccgggtcctcggactccgactttccngtccggtctccgtctccgtggaacagtacctcgccctacaccctagtaccggccggggccctaggaccgacgtcgaacgtgaccttgacgtattacgctacgtctccgttcttagtcggtgggtacgtcgtgaggtttcgggtcgttacggggcggtaccggaaccgtacgtaccggaccgttccggtacgtccgacggtacccgg

SEQ ID NO: 148879 - DNA, 666 bp, Homo sapiens
  misc_feature: GYAE6OF02HB3X6.15.34.D01.1.454.CMB.1.raw
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
  modified_base (449)..(449): a, c, t, g, unknown or other
  misc_feature (449)..(449): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtcgacccaggacgccatcgttctcgtacgtcgtccccgtggacggggacacggtcacacctctacgttgtcgtccttggacggttcctgggcttcacgttctctacttctaactccgcccgcctcggtaccggcacggaccccacggccagccctcaccgcacgctcatctacagtacaacactcnctcgtccgggtccctgactcgcttcncgtggcctcnctcgttacggaactaacgctcgccctcaccncgtccgaccggggccacggcacgacgatagactggtatacttagtacctacgttcggtccgtttccgtttacggttacggggtcggggtcccgggttgggtacgttttcgggtttcgggggttacggttccgggggtaacgggtaaccggggtaaacccgtaacggttacccgggtacccgttacccgttacggggtccctaaccgggtaccccggg

SEQ ID NO: 148880 - DNA, 660 bp, Homo sapiens
  misc_feature: GYAE6OF02HK3SP.15.34.D01.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagtctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtcgtcccctggagggacagtcacactcacttgtgccttgnggtctggctcagtctctacttctaactacgccgcctggtacccggcacgaccccaggccagcctccacgccacgctcatctacagtacaaacactcgctccttccgggtccctgactccgtcttcncgtgctcctatccgtcggaaacaancngccctacaccanaccgaccggggcccaggccaacggacgactagtaatcgtagtattactcgtacctgtccgtttctttggtgggtcgggtcggtggtcgttaggttttgggttcggttcgggccgggtaagggtaacccgtaaacgtaccgggtaccgttaccggtaccggtacaaccggcccggtaaggtacccgtcccgtcccccggtccgttacccgttacccgttccgttcccgttccccgccccgttccctccgttaccgttaccgggtaccgtcggttacggcggggaccggtccggg

SEQ ID NO: 148881 - DNA, 784 bp, Homo sapiens
  misc_feature: GYAE6OF02IJJF1.15.34.D01.1.454.CMB.1.raw
tcagtctacgtagccacgaccggtgctcgatttagatcgtctgtgttgggtttgggaacctatgaacattctgtaggggccactgtcttctcctcggactccttgcttatggatcagggagtggattctcagactggtggtgacccaggagccatcgttctcagtgtcccctggagggacagtcacactcacttgtgccttgaggtctggctcagtctctacttcaactacgccgcctggaccggcacgaccccaagccagcctccacgcacgtctacataccactacgtaacaaacactcgcgtccgttcccggggtcctggactcgacgttcctacgtcgccgtcctacgttacgttacggaaacaaacggcttccgacccttccaaccctacgtcccggaccggggggacccacgggtacgaacggaaccgagtcgtaaacgtgtaggtaattttacacggacgttcggtacccgtttacgttttaacgtacggggttacggggtacggttaggtacgttaggggtttttaacggggttcggtttccgggggtaacgggtaaaccggggtaaccgaaaacggttccggtaaaccccgggtttccgttaaacggggttaccaaccgggtaccccggttaaaagggcccgttccccggtaaccccgttcccggtaccgtaaccctttccggttaccccggtttcccctaaaccccggttcccgtacccggtaccgtttaccgggtaaaccggtacgtaccgggtacgggaccgggttacccgg

SEQ ID NO: 148882 - DNA, 616 bp, Homo sapiens
  misc_feature: GYAE6OF02FF29T.15.34.D01.1.454.CMB.1.raw
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggaggacagtcacactcacttgtgccttgaggtctggctcagtctcttacttctaactacgccgcctgtaccggcacgacccaggccagcctccacgcacgctcatctacagtacaacactcgcttccgttccggggtccctgactcgtcctttcgtctcggtcctccacttccgttacgggaaactaacgctcgccctacaccactccgaccggggcccagggcacgacgagtacgaattcggagtattacgtacctacgtcgtccgttaccgtttagtcgggtcggggtcgttcgggtacgtaggtttttggggtcggttccggggtacggtaacgggacccgtaaacgttcggaacccgttcggtacggtcgacggtaccccgg

SEQ ID NO: 148883 - DNA, 670 bp, Homo sapiens
  misc_feature: GYAE6OF02GZCDU.15.34.D01.1.454.CMB.1.raw
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtcgacccaggacgccattcgttctacagttcgtccccgtgggagggacacgtacacacctctacttgtacgccttaggacggttctggcttcgagttcctcttacttctaacctaccgccgtccgtacggtaccggcaccgaccccaggccacgcctccaccgcacgctcatctacaagtacaacnctcnctccgtccgggtcctgactcgtctctcgtcgctcnctacgtacggaacaacgtcctaccgccctaccacacggtaccggacccggggacccagggacccgaaggacgtacgtacgtagttacggtacgtactttaacctccgtacggttcgttaccgtttcgttagggttgggttccggggaggttcggtacgttttcgggtttcggggtcggttccggggacgggtaaccggtaacgtaacccgttcggacccggttacgtacggtaccgaccgtaacccggg

SEQ ID NO: 148884 - DNA, 677 bp, Homo sapiens
  misc_feature: GYAE6OF02HV42Z.15.34.D01.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (634)..(634): a, c, t, g, unknown or other
  misc_feature (634)..(634): n is a, c, g, or t
tcagtctacgtagccacgaccggtgctcgatttagatcgtctgtgttgggtttgggggaaaaggcctgaggaaaacaaaccccagctgggaagcctgagaacacttagccttcatgagtgtccccaccatggcctggatggactgcttcctccgtcggacttccgttgctttagtgatcagggagtggattctnatatgtgtcgaaccnggactctagtcttactacagttccgtcccgaggacggacnttccacgtacctcttacttgcgtcgttacgtagtcgtcgctactagtctacgttaccttacgtacgtacgtccgtacccgtcgggtaaccgtccgaaccgtacccgtacgacccgtaccgtccctaccgaccgtaccaccggtcctactactacgtaacacgtacaaaccgtctaccgtcgttccggtaccggttcctacggtacgtctcgttcgtagtccgtactcctacgtcgttacgaacgtacncgtaccgcctaccggtacnccggtaccgggaccggtacccgtaggaccgtaactacgttacgacgtactggttactagttcacgtactcggtacttcgttagnggttcggngttgtcgttcgttggtcggttacggngtaccgtactacggtcgtaccgtacgccgtacgtccgtaccgg

SEQ ID NO: 148885 - DNA, 637 bp, Homo sapiens
  misc_feature: GYAE6OF02IGX3G.15.34.D01.1.454.CMB.1.raw
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (354)..(354): a, c, t, g, unknown or other
  misc_feature (354)..(354): n is a, c, g, or t
  modified_base (477)..(477): a, c, t, g, unknown or other
  misc_feature (477)..(477): n is a, c, g, or t
tcagtctacgtagccacgaccggtgctcgatttagatcgtctgtgttgggtttgggggaaaaggcctgaggaaaacaaacccagctgggaagcctgagaacacttagccttcatgagtgtcccacatggcctggatgatgcttctcctcggactccttgcttatggatcgaggagtggtatttcncaagtctggtggtcgaccaggacgccattcgttctnagtcgtcccngggacgggacagtcactacctctacttgtgtccttaggaggttctggctgtacgtctcttacttactaacgtccgaccgtctcgggtaacccgcaaccgacccggacgtccaagtcccaaccncgccacgtctagacttacgactacgtaacaaacctcgtcgtactccgttccgggtcctaggtcttccgactttctcgtagtcccttcgactttcgtagggaaacacgtcgccgtccacgtacncgtccgggaaccggggcctaggaccgtaagaccgtattaggactagtctaagtcctaacgtgtccgtcgtttatttaggcgggttcggtagtcgtcgtttgggttggtcggtcggaacggacgtcgtaaacgtcggtactaacggtcgcaccggtacccg

SEQ ID NO: 148886 - DNA, 760 bp, Homo sapiens
  misc_feature: GYAE6OF02GB8IV.15.34.D01.1.454.CMB.1.raw
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (498)..(498): a, c, t, g, unknown or other
  misc_feature (498)..(498): n is a, c, g, or t
  modified_base (554)..(554): a, c, t, g, unknown or other
  misc_feature (554)..(554): n is a, c, g, or t
tcagtctacgtagccacgaccggtgctcgatttagatcgtctgtgttgggtttgggggaaaaggccctgaggaaaacaaacccctagcctgggaagcctggagaaccacttagccttcattgagttgtccccaccatggcctggatcgatgcttctcctacgactccttgccttatggatcaggagtcggattcttcagtacctggtaggtcgacccaggtacgccatcgttcgtccagttcgtcccctgggacggtacgcgttaccaacgacctcgtaccgtttgtacgaccgttacggtaggttcctggggcccttaccgtaaggttcccttcggttaacctttccgtaactaccggtccgtaccgttcgggtaccgacacccggaaccccgnggacccacgtcccncgaccnccgacgtcctacacttaccgaactaacgtaaccaaactccgtaccgtccttccggttcccgggacctcggtactccgcttacncgtcggcctacgtgttaccgtaggtactaacgtcgttctcccgtactaccgttacncccgggacccgggtaccacggtaccgaacgtacgtagtaccgtagttaccgttataaccgttaactccggtacgtaccggttacctttccgttaagtcgggtcgggtagtaccggtagtttaacgggttcgggtacgtttccggggaacgtttaaccggaaccgtaacttccgggtaccgttacggaccgttcgaaccggtacccg

SEQ ID NO: 148887 - DNA, 808 bp, Homo sapiens
  misc_feature: GYAE6OF02FUP4Q.15.34.D01.1.454.CMB.1.raw
  modified_base (306)..(306): a, c, t, g, unknown or other
  misc_feature (306)..(306): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
tcagtctacgtagccacgaccggtgctcgatttagatcgtctgtgttgggtttgggggaaaaggccctgaggaaaacaaaccccagctgggaagcctgagaacacttagccttcatgagtcgtccccaccatggcctggatgatgcttctccgtcggaccttccttgtcttatggtactcgaggtagtggattctcagacgtgtggtacgacccgaggcgcctaagttccgttctctacgttcgtccccgtggggagggacacggtccacctactccgtacttggtcgtccgttggacggttccgnggcctacacgttctcttaccttacctaacctaccgccgtccgtacgggtacccgcgtacccgaccccgacggcccgaccggtcccctaccgaccgacccgaccggtcctacgtaaccttacccgttacgaaccggttaaaccaaaaccgtccgtacccggtcccgttccccggggtttccccggggttaccctcgtcgtccgtccctttacgttccgtccggtaaccttccctacgttcccgggtttaaaggaaaccgttaaccncgttaccncccctaccaaccgtacggtcccgggacccggtaaccccggtagaccggacggtaaccgtataccggtaagtcgttagttaaccttgtaccgttacttccgggtttaaccttcggtttagtacgggggttcgcgggtttatcgggtttggtttcgggtacgggttccgggtaacgggaccgtaacggtccgtacggttacccggtaagtcggaccgtaccggtaacccgg

SEQ ID NO: 148888 - DNA, 790 bp, Homo sapiens
  misc_feature: GYAE6OF02IPE67.15.34.D01.1.454.CMB.1.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (558)..(558): a, c, t, g, unknown or other
  misc_feature (558)..(558): n is a, c, g, or t
tcagtctacgtagccacgaccggtgctcgatttagatcgtctgtgttgggtttgggggaaaaggccctgaggaaaacaaacccccagctgggaagcctgagaacacttagccttcatgagtcgtccccaccatggcctggatgatgcttctcctcggactccttgcttatggatcaggagtggattctcagtactggtggtcgacccgaggcgacctatccggttctccgtagtccggtccccgngggaaggggaaccacggtaccgaacnccgtaccacgtttggtacgtccgttcggtacggtccgttggtccctacgtacggttcctacgttacctttaacctaaccggtaccgtacccgtacccgttccgggtacccggtaccgaaccccggaccccgaacgggtacccaccggtcccnccccgacnccgtaccgactaccgtacttaccaactaccgaacaaacccgtacgtccgaccgttccgttcccgggtaccngtactcgtcttccncgtcggtcctactacgttaccggtaacggtaaacctaaccgntacccgtaccccttccaacgtccgtacccgggaccgggccgaccgccgagtaccgagtacgattgaacgttacttacctagtacgttacgttacgttacccgttggtcggggtacggggtccgtacggtcgtttacgggtttcggggtaccgggtacgggtaaccgggtaccggaaccgtaaccgggtacgttacccggtaccgggttacgtaccggtaccccgtaaccggg

SEQ ID NO: 148889 - DNA, 593 bp, Homo sapiens
  misc_feature: GYAE6OF02G85E7.15.34.D01.1.454.CMB.1.raw
  modified_base (204)..(204): a, c, t, g, unknown or other
  misc_feature (204)..(204): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (556)..(556): a, c, t, g, unknown or other
  misc_feature (556)..(556): n is a, c, g, or t
  modified_base (564)..(564): a, c, t, g, unknown or other
  misc_feature (564)..(564): n is a, c, g, or t
tcagtctacgtagccacgaccggtgctcgatttagatcgtctgtgttgggtttggggcagggagtgggctaaggtgaggcaggtggcgccagccaggtagcacacccaatgcccgtgacgcccagacactggaccctgcctggaccctgtggatagacaagaaccgagggcctctgcgcccgtgggcccagctctcgtcccacnccgcggtcacatcggccacccacctctacgttcgccacgccctaccgaaccgaccggccctagttcccggttcccttcccccggtggccccgtccccgttcgtccgtccgaacggtcgcctacccgtccgaagtaccgacgacggcccggtcccgtgggcctcggtccgtggtaaccaacggtacctacgttcccgacgttaacgtacgaccgtcggacgggtccggacgtagggacaacgggccgacctatacgcagtcagcctgacncgncgtacngcgntatcncngacncgcgcgagacncgtcgcgtcncgtcgtcgcgcgacgcncngtacgagtcgtgtcgtcgntcgtcgtntgacgcgagtacgacgtcacgtctctgtc

SEQ ID NO: 148890 - DNA, 531 bp, Homo sapiens
  misc_feature: GYAE6OF01DSH2B.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggctagtttattactgtcagctaattattttcgtgtcttccgtactacttttggccgtaggggacccagggtggagatacgagacgaacgtggtcggactcgccaccgtacttcgttcgttcttctacttccttccccgtacc

SEQ ID NO: 148891 - DNA, 559 bp, Homo sapiens
  misc_feature: GYAE6OF01BKKIH.26.72.G06.1.454.CMB.1.raw
  modified_base (215)..(215): a, c, t, g, unknown or other
  misc_feature (215)..(215): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttanacaggtccgacaataagaactacttagcttggtaccagcagaaaccaggacagcctcctaatctactcatttactgggcctctacccgggaatccggggtctctggccgattcagtgccagcgggtctggacagagttcactctcaccatcagcagcctgcaggctgaagatgtggctagtttatactgtcagctaattattttcgtgtccttccgtactacgttttcggcccgtaggggaccctagggtcggagtacgtcgaacgaccgtaaacgtggtacggactcggaccaacccgtattccgttcgttacctttaccaacttcccgttcccccgtacccg

SEQ ID NO: 148892 - DNA, 524 bp, Homo sapiens
  misc_feature: GYAE6OF01CW2S2.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtcctttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggccctggacaaggacttgagtggatgggatggatcagcccttataatggtaacacgaagtatgcacgaagctccagggcagactctccatgaccacagacacatccacgagcaacaacataacatggaattgaggagcctgagatcgtgaacgacacggccatgtattactgttacgagtagggtacggtgacgaacgaacaacgtggggaccagggaacctggacaccgtctctcgacg

SEQ ID NO: 148893 - DNA, 533 bp, Homo sapiens
  misc_feature: GYAE6OF01C0EWA.26.72.G06.1.454.CMB.1.raw
  modified_base (226)..(226): a, c, t, g, unknown or other
  misc_feature (226)..(226): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccganaataagaactacttagcttggtaccagcagaaaccaggacagcctcctaatctactcatttactgggcctctacccgggaatccggggtctcgtggccgattcagtgccagcgggtctggacagagttcactctcaccatcagcagcctgcaggctgaagatgtgctagtttatactgtcagctaattattttcgtagtccttccgttaacctacgttttcggcccgtaggggtaccctagggttggagactcaaggacgtaacgtggtcggctgccacctatcttgtcttcacttccttcccgacc

SEQ ID NO: 148894 - DNA, 565 bp, Homo sapiens
  misc_feature: GYAE6OF01EZLPW.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgtttatacaggtccgacaataagaactacttagcttggtaccagcagaaaccaggacagcctctaatctactcatttactgggcctctacccgggaatccggggtctctggccgattcagtgccagcgggtctgggacagagttcactctcacatcagcagcctgcaggctagagatgtggctagtttattactgtacagctaattattttcgtgtcttccgtaacttaccgttttcggccgtacgggggaccctaggggttggacgtactacgacgtaccggaaacgttggtggcctaggccctaacccgtagttccgttacggttcctttaccgtaacttcccgttccccggtaccc

SEQ ID NO: 148895 - DNA, 539 bp, Homo sapiens
  misc_feature: GYAE6OF01EF9J2.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggccctggacaaggacttgagtggatgggatggatcagcccttataatggtaacacgaagtatgcacgaagctcgaggcagactctccatcgaccacagacacatccacgagcacaacatacataggaattgaggagcctgagactctagacgacacggacctatagtattacgtgttcgaggtagggtacggtagacgacgaacacggtgggacccgagggaacccgtggaccacccggtctcccgtcgtaccg

SEQ ID NO: 148896 - DNA, 542 bp, Homo sapiens
  misc_feature: GYAE6OF01A9M9S.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctagaagatgtggctagtttattactgtcagctaattattttcgtgtccttccgttactacgttttcggaccgtaacggggtacccagggtaggagagtaccgaagacgtaacgtggtcggtctggccaacctagttctcgttcttacacttccgttcccgtcc

SEQ ID NO: 148897 - DNA, 599 bp, Homo sapiens
  misc_feature: GYAE6OF01DAXFP.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaacaggacagcctctaatctactcatttactgggcctctacccgggaatccggggtctcgtggccattcagtgccagcgggtctgggacagagttcactctcaccatcagcagcctgcagctgaagatgtggctagtttattactgtcagcaattattttcgtgtctccgttaactacgttttcggaccgtacggggaccccgtagggtacggagtaacgtaccgtaacggaaaccggtaaacgttggttcgggtaccgtttacgggccgtaaccccgtaactttacccgttacggtttacccgtttacccttaacctttcccgttttccccccggtaacccccg

SEQ ID NO: 148898 - DNA, 628 bp, Homo sapiens
  misc_feature: GYAE6OF01AF2H8.26.72.G06.1.454.CMB.1.raw
  modified_base (213)..(213): a, c, t, g, unknown or other
  misc_feature (213)..(213): n is a, c, g, or t
  modified_base (287)..(287): a, c, t, g, unknown or other
  misc_feature (287)..(287): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttanacaggtccgacaataagaactacttagcttggtaccagcagaaaccaggacagcctctaatctactcatttacngggcctcgtaccggatccgggtctcgtcggccgtattcgagtcgccgaggtccgggtcgtgggacagtacgttccactctaccacctatccgagccacgtccctggacgacggtctaggaagtagtggtggtacttaagtttaacttacgtgtacgaagtactaatttacgttttacgtcgtccgttaccgttaacgttaccgttttacgggacccggtaaccggggtaacccgtaggggttacggacgtacgtaccgaacgtaaccggtaacgttggtcggactacggaccctaaccgtacttccgttcgttccttactaccttcccgttccccggtacc

SEQ ID NO: 148899 - DNA, 584 bp, Homo sapiens
  misc_feature: GYAE6OF01AG95O.26.72.G06.1.454.CMB.1.raw
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctcgtggccgattcagtgccagcgggtctggacagagttcactctcaccatccagcagcctgacacggctagaagatgtgcgtagtttattactgtcgagactaattacgttttcgtgtcctaccgttacttacgttttcggacccggtaaggggaccccgtagggtacggagtacgtacgaggtaaccgaacgtcggtacggcgttcggaccgacccgtaacttccgttacgtttacccttactacctttccccgttccccggtaccc

SEQ ID NO: 148900 - DNA, 628 bp, Homo sapiens
  misc_feature: GYAE6OF01A9WF0.26.72.G06.1.454.CMB.1.raw
  modified_base (213)..(213): a, c, t, g, unknown or other
  misc_feature (213)..(213): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttanacaggtccgacaataagaactacttagcttggtaccagcaagaaaccaggacagcctcctaatctactcatttactgggcctcgtacccgggaatcccggggtctcgtggccgattcagtgccaggcgggtctgggacagagttcactctcaccatcagcagccctgcaggctagaagatgtggctagtttattactgtcagtactaattattttcgtcgtccttccgttaacttaccgttttcgggaccgtacggggtaacccgtagggtacggaagtacgtaccgaacggtaaccggtaaacgttcgggttcgggtaccgttacggacccctaaccccgtaacgttttacccgtttaccggtttacccttttaaccgtaacccttttccccgtttcccccccggttaaccccg

SEQ ID NO: 148901 - DNA, 562 bp, Homo sapiens
  misc_feature: GYAE6OF01EJMKW.26.72.G06.1.454.CMB.1.raw
  modified_base (390)..(390): a, c, t, g, unknown or other
  misc_feature (390)..(390): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgtttatacaggtccgacaataagaactacttagcttggtaccagcagaaaccaggacagcctcctaatctactctatttactgggcctctacccgggaagtccggggtctcgtggccgattcagtgccaggccgggtctggacagagttcactctcaccatcagcagcctgcaggctgaagntgtggctagtttattactgtcagactaattacttttcgtgtccttccgttaacttacgttttcgggccgtaacggggaccccgtagggtagggagacgttcgaggaccgtaaacgttggtcggtcgtcgccacctagtcgttcgttcttacctacttccgttcccccgtacc

SEQ ID NO: 148902 - DNA, 576 bp, Homo sapiens
  misc_feature: GYAE6OF01AKVYS.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggccctggacaaggacttgagtggagtgggatggatcagtccttataatggtaacacgaagtatcgcaaccggaagctaccgagggcagactctccatcgaccacagacacactccacgagacaacaacataacataggaattaggaggacgccgtagagactacgtacgaacgacgaccgactagttgttacttacgtgtacggaggtacgggtacggtacgacgtaacgaacgacgggtacgggaccgaacgggtacccgtcggtaccgaccgtccgtccgtcgtacccg

SEQ ID NO: 148903 - DNA, 571 bp, Homo sapiens
  misc_feature: GYAE6OF01EEWGP.26.72.G06.1.454.CMB.1.raw
  modified_base (277)..(277): a, c, t, g, unknown or other
  misc_feature (277)..(277): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagtctttacgactatgtatcactgggtncgacacggccctggacaaggacttgagtggagtgggatggatcagtccttataatggtaaacacgtaagtatgacaccgaagctacgagggcacgactctccatacgaaccaacagaaccacactacccacgacacaacaacaatacagtacggaattggaggacgaccgagactcagacgacgacggccagtagttattacgtgttacgaggtagggtaacgtgaaacgtaacgaacgtaacggtcgggaccaacggggtacctcgggtaccaccggtctccctgcgtacccg

SEQ ID NO: 148904 - DNA, 555 bp, Homo sapiens
  misc_feature: GYAE6OF01CHXPF.26.72.G06.1.454.CMB.1.raw
  modified_base (278)..(278): a, c, t, g, unknown or other
  misc_feature (278)..(278): n is a, c, g, or t
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagtctttacgactatggtatcactgggtncgacaggccctggacaaggacttgagtggatgggatcggatcgagtcccttataagtaggtaacacgtaagtatgacacgtaagctaccgaggcagtacctctaccatcgaccacgacgacacgactaccaacgacgacaacaacaactacaataggaattggagganacctagagatcgagacgacgacgacagtgtattacgtgtcgaagtgggtacgtgacgacgaanacggtcgggaccacgggtaaccgtcggacaccgtctcgtcgtaccg

SEQ ID NO: 148905 - DNA, 611 bp, Homo sapiens
  misc_feature: GYAE6OF01B0TQQ.26.72.G06.1.454.CMB.1.raw
  modified_base (216)..(216): a, c, t, g, unknown or other
  misc_feature (216)..(216): n is a, c, g, or t
  modified_base (406)..(406): a, c, t, g, unknown or other
  misc_feature (406)..(406): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagttgttttanacaggtccgaacaaataagaacttacttagcttggtaccagacaagaaaccaggacagcctactaatctactctatttactggcctcgtacccgggaactccggggtctcgtggccgtattcgagtcgaccaggtcgggtcgtggacagtagttcactctacaccatcagcacgcctgcaggctagaagngtgtgacttagtttattacgtgtcagactaattatttcgtctccttaccgttacttacggttttcggacccggtacggggacccgtagggtacggacgtacgtacggaacggtaccgtaaacggttggtcgggtactacgggtaccctaacccgtacgttccgtttacgttccctttacctacctttccccgttccccgtacccg

SEQ ID NO: 148906 - DNA, 583 bp, Homo sapiens
  misc_feature: GYAE6OF01BFPD3.26.72.G06.1.454.CMB.1.raw
  modified_base (215)..(215): a, c, t, g, unknown or other
  misc_feature (215)..(215): n is a, c, g, or t
  modified_base (528)..(528): a, c, t, g, unknown or other
  misc_feature (528)..(528): n is a, c, g, or t
  modified_base (541)..(541): a, c, t, g, unknown or other
  misc_feature (541)..(541): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggcgagagggccaccatcaactgcaagtccagccagagttgttttanacgaggtccgacaataagaactacttagcttggtaccagcaagaaaccaggacagcctcctaatctactcatttactggcctcgtacccgggatccggggtctcgtggccgattcagtcgccgaggccgggtctggacagtacgtcactctcaccatcagcagcctgcgaggctagaagagtgtggactagtttacttacgtgtcgaacgtctaatttacttttcgtcgtccttccgtaaccttacgttttcggacccgtaggggtacccctagggtacggagtacgtacgacgtaccgtaacgtggtacgtntcggtccaccgtnttaccgtcgttaccttacctacgttccccgttccccgtaccg

SEQ ID NO: 148907 - DNA, 646 bp, Homo sapiens
  misc_feature: GYAE6OF01D0GWV.26.72.G06.1.454.CMB.1.raw
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagaggccaccatcaactgcaagtccagccagagttgttttaanacgaggtaccgaacaaataacgaaacttacttagtcttacggtaccagacaagaaaccaggacagcctctaatctactcatttacnggcctcgtacccgggatccggggtctcgtggccgattcagtcgccgaggcgggtcgtgggacagtacgttcactctacacccaatccagcacgcctgcgaggctagaagtcgtggtggtactagtttaattacgtgtacgtagactaagttaaactaaaacgtcggtacccgttaccgtcgggtaacggttaccggacccggtaaacgggaaccgtaaaggggtaacgtaaacggtaaccgaaaacggtaaccgtacggtacggtaccgtacgtacccaacgttactacgtttacgttacccgtttaccgtaacctttcccgtttcccccgacctacgtttaaccg

SEQ ID NO: 148908 - DNA, 830 bp, Homo sapiens
  misc_feature: GYAE6OF01B5GIQ.26.72.G06.1.454.CMB.1.raw
  modified_base (220)..(220): a, c, t, g, unknown or other
  misc_feature (220)..(220): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagacctccctggctgtgtctcgtgggcgaggagggccaaccatcaactgacaagtccagccagagttgttttaanacaggtaccgaacaaataagtaactacttagtcgttaggtaccagacaagaaaccaggacagcctacctatctactctaattcgcggtcctaccgtaccgggtaacgtccgggtctccgtggaccgtattcgacgtcgccgaggcgggtacgtggaacaggtacgttaccaccgttcctaccaaccctacgtaccgacggacctaaccgggtcccacggtaccgacgggtaccgtaacggtaaacgtaaggtcgggttaccgggtacgtttaacggttttaaacgtttaccgttaggttaaccgtaacggtaacctttaaacgtttttacgtttttaccggttaccggttaccccgttttaacccggtttaaccgtttaaccgggttttttacccggggaaccccggggttaaacccggggggtaaacccccggttaagggggttaaccggggtaaacggttaaccggtaaccggtaaaaccgtaaacccgggttaaacggttcgggtaccgggttaccgttacccggtaacccgtacccgtaaccgtttacccggttacgtttcccgtttaaccgttacccgtttccccgtttacccccgttaaacccg

SEQ ID NO: 148909 - DNA, 592 bp, Homo sapiens
  misc_feature: GYAE6OF01A2144.26.72.G06.1.454.CMB.1.raw
  modified_base (403)..(403): a, c, t, g, unknown or other
  misc_feature (403)..(403): n is a, c, g, or t
  modified_base (450)..(450): a, c, t, g, unknown or other
  misc_feature (450)..(450): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgaccctagtctccagacctccctggctgtgtctcgtgggcgagagggccacatcaacgtgcaagtccagccaggagttgttttaacacaggtccgaacaataagaacttacttagccttggtaccagacaagaaaccgaggacagcctacctaatctactctattacgcggcctacgtaccgggaactcccggggtctcgtcgggcctattcgagtcgccgaggcgggtctagggacaggtagttcactctcaccatcagcacgcctgcngctagagtgtggtcgactagtttattacgtgtactagacttaagttntttacgtcgtccttacgtactacggtttccggaccggtacgggtacccgtagggtacggagtacgtacgaaggtaccggtaacgtgggtacgtcgtcgccacgtctcgttcgttccttactacccgttccgttcccgtaccg

SEQ ID NO: 148910 - DNA, 550 bp, Homo sapiens
  misc_feature: GYAE6OF01A6227.26.72.G06.1.454.CMB.1.raw
  modified_base (249)..(249): a, c, t, g, unknown or other
  misc_feature (249)..(249): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagagcctggggcctcagtgaacgtctcctgcaaggcttctggttacngctttaccgactactggtatcacctgggtgcgacaggccctggacaggacttgagtggatgggatggatcagcccttataatggtaacacgaagtatgcaccgaagctcgaggcagacctctcccatcgaaccacgagaacacactacacgacgacaacaacactacatgaattggagagcctgagatctgacgaacacggcctatagtacttactcgttacgaggtagggtacggtgaaccacggaacaacggtcgggaccgtacgggaacccgtggtaccacggtcctccgtcgtaccg

SEQ ID NO: 148911 - DNA, 605 bp, Homo sapiens
  misc_feature: GYAE6OF01AMDML.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagagcctggggcctcagtgaacgtctcctgcaaggcttcgtggttacagtctttaccgactatggtatccaccgtgggtcgcgacgacggccctggacaaggtcttgagtggatgggatggatcgacgtcccttaataagtggtaacacgtaagtatcgacacgagctcgaggcagactcgaccatacgaccacgagacacactacccaacgacgacaacgaacaactaacgaagtacggaattaggaacggtacgccgtaggactagtcgtacgaaccgacgaccggacctaagttgtaacgtttacgtagttacggaggtacgggtacgtacgaacgacgaacgacggtcgggacccgaacgggtacccgtcggacccgtaaccgtccctcgtcgtacccg

SEQ ID NO: 148912 - DNA, 680 bp, Homo sapiens
  misc_feature: GYAE6OF01ECLC6.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggcgaggacgggccaccatcaactgccaagtccagccagagttgttttatacaggtaccgacaataagaactacttagcttaggtaccagacaacgaaaccgaggacacgcctacctaatctactctatttacgtggcctccgtacccgggaacgtcccggggtctcgtggacctattcagtcgaccgaggtcgggtcgtcgggacagtacgttcaccgtctaccgacctatcacgtaccaggtcccgtaggcgacgggtcgtaacggaagtagtaggttacggtacgttaagtttttacttacgttaggtaccgtaagtacgtaaacgttaaacgtaaaaccgttcggtacccgttaccggtacgggtaaccggtttaccggaaccgggtaacgggtaacccggaaagggtaacggtaaacgtaaccgaaaacgtaacgtaggtacggtacgtacgacaccgtactccgttgtacctttactaccttacccgttcccgtccgtacgttacg

SEQ ID NO: 148913 - DNA, 587 bp, Homo sapiens
  misc_feature: GYAE6OF01A99Q4.26.72.G06.1.454.CMB.1.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttanacaggtccganaataagaactacttagcttggtaccagcaagaaaccaggacagcctcctaatctactcatttacgtgggcctcgtacccgggaatccggggtctcgtcggccgattcagtcgccaggtcgggtctagggacagtacgttcactctcacatcagcacgcctgcaggctagaagtagtgtggtactagtttattactgtcgagtactaattcgttttcgtgtccttccgtacgttacgttttcggacccgtacggggtaccctagggtcggaacgtacgtacgaagtaaccggtaacgttggtcgggtacctcggacctaccgtacttccgttacgttccttacactttcccgttccccgtaccg

SEQ ID NO: 148914 - DNA, 829 bp, Homo sapiens
  misc_feature: GYAE6OF01ELR9P.26.72.G06.1.454.CMB.1.raw
  modified_base (252)..(252): a, c, t, g, unknown or other
  misc_feature (252)..(252): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgttccttttcttggtggcagcagcgacaggtcgcccactcccaggttcagctggtgcagtctggaggtgaggtgaagagccgtgggcctcgagtcgaacgtctctgacagtcttcgtagtacngtctttacgactagtgtactcgtacggtggtcaccggaccgaccggtcccgtaggaaccgtaacggtacgttggacggtgggtaggtggggtagtacggactaccgacgttacccgtttaagtaacgtaacggtaaacgaacggtaagttagtaccgaacgtaaccggacgtccgtaccggagggtaccaacgtcccttacgtaccgaacgtacccgaacctaacgaccgtaaccaaccgtaccgtacccggaaaccggtacgaaccaaaccctaaaccgtaacgttaaacgtaagggttaacggtaacggttaggaaccgggtaccgtacgtacggtaacgtcgttaacgacggaacccgtaacggaccggttaccttaaggttcggtttaacgttaccggttacgggtaacggaacggggttaaccgggttacggaaccggaaaacccggtaccggtaaaccggggttaacccggggtacccggggaaacccggttaaaccccggggtaaccccgtttaccggggaaccccccttaacccgggttccccgttcccgtaacccggtaaccccccgg

SEQ ID NO: 148915 - DNA, 638 bp, Homo sapiens
  misc_feature: GYAE6OF01A18YO.26.72.G06.1.454.CMB.1.raw
  modified_base (280)..(280): a, c, t, g, unknown or other
  misc_feature (280)..(280): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagagcctggggcctcagtgaacgtctcctgcaaggcttctggttacagtctttaccgactatggtatcaccgtgggtncgacgacggccctggacaaggacttggagtggagtgggatggatcgacgtacccttaataagtacggtaaacacggtaaagtagtacgaccaaccggaagcctaccgagggcagactctacatacgaccacagacacactccacgacgacaacaacactaacagtaggaattggaacggtacgaccgtagagtactacgtagaaccgacgaccggacctaagttacgttaacttacgtaggttacggaagggtacggggttaccggtacggaaccgaaccggtaaacgaacgggtccggggtacccgaacggggtaacccgtcgggtaccctacccggttccctccgtccgtacccgg

SEQ ID NO: 148916 - DNA, 850 bp, Homo sapiens
  misc_feature: GYAE6OF01EN89G.26.72.G06.1.454.CMB.1.raw
  modified_base (138)..(138): a, c, t, g, unknown or other
  misc_feature (138)..(138): n is a, c, g, or t
tcagagactatactcacgaccggtgctcgatttagctacgactgcaagggaagggcagcaagatggtgttgcagacccaggtcttcatttctctgttgctctggatctctggtgcccgcgggacatcgtgatgacccngtctccagacctccctggctgtgtctcgtgggcgaggacgggtccaaccatcaactgacaagtccaagccaggtagttgttttacacgaggtccgaactaaataagaactacgttaggtcctttagggaaccacgacgaaacgaaaacccgagggtaaccaaccgtacccttacccgttaaattaccctttaaccgttactaacgtttttaaccggtcggggggtccccttaaccggtaaccccgggggtaaacgttccccgggggggttacttaccgtcggggacccgttaatttaccgaacgggttcgccccgaagggttccggggttaccgttagggggaacctaaaggggtacgttttacccgaaaccgtttccttaacccgaaaccctacgttaccgtaaacgcccgaaaccggttaccccttgggacccggaaggtaccgttaaggaaacggtacgttaaggggtacggtacgtttaacggttttaatttaacccgttagtacggtaacgtacttaaagtttagttttcggtacgtaccgttaccggttaacttaccggttttaccggaccgggttaacggggtaacccgtaggggtacgtacggtaacgttccgtaaacgggaccgtaaggttacggtcgggttatccggtacctacccgtaattccgttacgttctttacctacgtttcccctaccgttacccg

SEQ ID NO: 148917 - DNA, 719 bp, Homo sapiens
  misc_feature: GYAE6OF01AFCQ6.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagccgtggggcctcagtgaacgtctcctgcaaggcttctggttacagtctttaccgactatggtatcaccgtgggtcgcgacgacggccctaggacaaggtacttgaggtggagtgggatggatcgacggtccctttaagtaagtcggtaaacacgaagttatacgaccaaccggaagcctaccgagggacagactctaccatacgaccacgacgaccacactaccaacgacgaccaacaaactaactaaccgtaagttacgggaaagtttagggaacgggtaccgtacccgttagaacggtacttaccgtacggaaccggaaccgtacccggaccttaagttaccgttaacgttttaccgttacgggttaacggtaacgggtacgggggttaaaccggtacgaaacccggaaaccggtaaacgggtaaccgggtcgggggaacccgtaaaccgggggtaaaccccgttcggggtaacccgtacccggttcccgttaccgtcccggtaacccgg

SEQ ID NO: 148918 - DNA, 640 bp, Homo sapiens
  misc_feature: GYAE6OF01D0Q31.26.72.G06.1.454.CMB.1.raw
  modified_base (219)..(219): a, c, t, g, unknown or other
  misc_feature (219)..(219): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagacctccctggctgtgtctcgtgggcgagacgggccaccatcaactgacaagtccagccagtagttgttttanacgaggtaccgacaaataagaacttacttagcttaggaccagacaacgaaaccaggacacgcctacctaatctactctatttacgcggcctcgtacccgggaagtcccggggtctcgtcggccgtattcgagtcgccgaggcgggtcgtggacagtacgtcactctcaccatcagcacgcctagcgaggtctaggaagtagtggtggtacttaaggtttacttacgtgtacaagtacttaaatttcgttttcgtcgtccgttaccgttacttacggtttacggacccggtacggggtacccgtagggtacggactaacgtcgaaacggtaaccggtaagtcgggtacggtcttacggacctaacccgttagttacccgttcggtttaccttacccgtaccctttccccgtccccgtaaccg

SEQ ID NO: 148919 - DNA, 725 bp, Homo sapiens
  misc_feature: GYAE6OF01BHHZ2.26.72.G06.1.454.CMB.1.raw
  modified_base (225)..(225): a, c, t, g, unknown or other
  misc_feature (225)..(225): n is a, c, g, or t
tcagagactatactcacgaccggtgctcgatttagctacgactgcaagggaagggcagcaagatggtgttgcagacccaggtcttcatttctctgttgctctggatctctggtcgcccggcggggacatcgtgatcgacccagtcctccagacctccctggctgtgtctcgtgggcgaggacggcccacatcaactgacaagtccagccaagtagttgttttaanacgacggtaccgaataaaataaacgtaacttacgttaagtccgttacggtaaccagaccgaaacgaaaaccgaggaaccacgtaccctacctaatctactctactttaccgcggtcctaccggtacccgggtacgtccggggtctcgtcggtaccgtattccgaggtcgaccgtagggtccgggtcgtacggaacgtaggtacgttaccaccttccctaccgaacctataccgacgtccaaccgtccgtagacgacggctaaggaagtcgtaggtacgtacttaagtttagtacgtgtacaagttactaatttacgtttcgtactacccgtttacgtaaccgtttaccggtttacgggacccggtaacggggtacctagggtacgtactacggtaccgaaacggtaaccggtaacggttgggtaccggtacgtaccggtaaccacccgttatttcccgtttacgttcccgttaactcccgtttcccggttaccccgaacg

SEQ ID NO: 148920 - DNA, 741 bp, Homo sapiens
  misc_feature: GYAE6OF01CE2A1.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgttccttttcttggtggcagcagcgacaggtgccccactcccaggttcagctggtgcagtctggaggtgaggtgaagagccgtgggcctcgagtgacgtctcctgcaggcttcgtggttacagtctttaccgacttagtggtatccgacgtgggtgcgacgacggcccgtaggacaaggtacgttaggaggtaggagtgggatggatccgacgtacctttaataacgtaggtaaacgacgtaaagttacgacgaccgaaccgaagccgtaccggaggcaaggtacctcctaccacgtaccgaaccacgacgaactacacgtacccgacgacgaacaaacaaacagtaacgaagtacggtaattacgggaacggtacgaccgtaggaacgtacgtacggtacgaaccggaaccgtaccgggtaaccttaagttacgtttaaccgtttacggttacgggttaacgggaaggggtaaacggggttaccggtaaacggtaacccggtaaaccggaaaaccgggtaaccggggttacccgggggaacccggtaaaccggggtaacccccttcgggtaaccccgtaccgttcccccgtttaccgacccgtaaccccgg

SEQ ID NO: 148921 - DNA, 529 bp, Homo sapiens
  misc_feature: GYAE6OF01A3UBV.26.72.G06.1.454.CMB.1.raw
  modified_base (214)..(214): a, c, t, g, unknown or other
  misc_feature (214)..(214): n is a, c, g, or t
  modified_base (288)..(288): a, c, t, g, unknown or other
  misc_feature (288)..(288): n is a, c, g, or t
  modified_base (396)..(396): a, c, t, g, unknown or other
  misc_feature (396)..(396): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggcgagagggccaccatcaactgcaagtccagccagagtgttttanacaggtccgacaataagaactacttagcttaggtaccagcagaaaccaggacagcctctaatctactcattacnggcctctacccgggaatccggggtctcgtggccgtattcagtcgccgaggcgggtcgtgggacaggacgttcactctccgaaccatcagcacgcctgcaggctgaagntgtggctagtttacttatgtacagctaattatttcgtgtcctcgtacctacgttttcggccgtacgggacctagggtggagagtcgagacgtacgtggtggctgccacatctgtcttacacttcctcccgtac

SEQ ID NO: 148922 - DNA, 594 bp, Homo sapiens
  misc_feature: GYAE6OF01A1N1N.26.72.G06.1.454.CMB.1.raw
  modified_base (465)..(465): a, c, t, g, unknown or other
  misc_feature (465)..(465): n is a, c, g, or t
  modified_base (502)..(502): a, c, t, g, unknown or other
  misc_feature (502)..(502): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtcctttcttggtggcagcagcgacaggtgcccactcccaggttcagctggtgcagtctggaggtgaggtgaaagaagccgtggggcctcagtgaacgtctccgtgcaaggcttcgtggttacagtcctttaccgacttagtggtatcgtaccgtgggtgccgacacggtccccgtaggacgaacggacttgacggtggagtggatggatcgacgccctataagtcggtaacacgaagtatcgcacgagctacgaggcagactcgtacagtcgaccacgacgaccactactacccgacgacgaccaacgaacacgtacataggaactgagacgacnggagctcgagacgacgcggactagtacgttattacgngttacgaggtagggtacggagaccgacgaacgaccggtcggggaaccctacgggaccccgttacggccgtacccgccgtcccgtcgaacccg

SEQ ID NO: 148923 - DNA, 922 bp, Homo sapiens
  misc_feature: GYAE6OF01B4JR4.26.72.G06.1.454.CMB.1.raw
  modified_base (291)..(291): a, c, t, g, unknown or other
  misc_feature (291)..(291): n is a, c, g, or t
  modified_base (814)..(814): a, c, t, g, unknown or other
  misc_feature (814)..(814): n is a, c, g, or t
tcagagactatactcacgaccggtgctcgatttagctacgactgcaagggaagggcagcaagatggtgttgcagacccaggtcttcatttctctgttgctctggatctctggtcgcccgcggggacatcgtgatgacccagtctccagactccctggctgtgtctcgtgggcgaggagggccaccatcaactgcaacgtccagccagtagttgttttatacgacggtaccgaaccaaataacgtaaccttacgttagtcttacggtaccaagacaacgaaaccgacggacncgacctacctaatcctactctatttaccgcggtacctccggtacccggtacggtcccgggtctaccggtcggtccgtattcgaggttccgaccgtacgggtccgggtcgtacgggacgtaggtacggttaccaccttcccgacctaacctacgttacccgaacggtccgaccggtacccgtcggcctaaccggtcccgttgggttaaccgggtttaatttttaccggggaaccctttaaaccgtttttaagtttaccccggtcggtaccccgtaagttacccgttaaaaggtttacgttaaaccgtttaccgtaaccgttttttaaaccccccgttacgttacccccgggttaaaccccgggtttcccgggggggggtaaccccccgggggtaacggttacccccggggttaaacccggttaaacccggggttaaaaaccgtaaaacccccggggtttaacgggttacccgggggttacgggtaccccgttaaccgggttacccccgtaaaaccccgggtttntttacccccgggttttaccgggtttaaccctttttaccccgtaaccccgtttttaccccccggtaaccccccgttcctttaaacccggtttcccgggtttaaaacggg

SEQ ID NO: 148924 - DNA, 664 bp, Homo sapiens
  misc_feature: GYAE6OF01D8EVL.26.72.G06.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (296)..(296): a, c, t, g, unknown or other
  misc_feature (296)..(296): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggcgagagggccaccatcgaactgcaagtccagccagagttgttttanacgaggtccganaataagaactacttagcttggtaaccagcaagaaaccaggacagcctactaatctactctatttacgnggcctcgtacccggggtaactccggggtctcgtggccgtattcaggtcgccgaggtcgggtcgtacgggacaggtagttcactcgtaccaccgtataccagccaacggccctggacgtacgggcgtagaaggtacgttaggttgggacgtttaagttttacttacgttacgttacgacgtacgtaaactttacgttttcgtacgttccttacccgttaacttaaccggttttccgggacccgtaacgggggtaccccgtaggggtacggtagtacgtacgaacggtacgaaaccgttggtacggtgttacgcccgtaacctacgttcgtttaccgttacgttacccttacgtcccgttccccgtaccg

SEQ ID NO: 148925 - DNA, 660 bp, Homo sapiens
  misc_feature: GYAE6OF01CQG6C.26.72.G06.1.454.CMB.1.raw
  modified_base (645)..(645): a, c, t, g, unknown or other
  misc_feature (645)..(645): n is a, c, g, or t
  modified_base (652)..(652): a, c, t, g, unknown or other
  misc_feature (652)..(652): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgttcctttcttggtggcagcagcgacaggtgcccactcccaggttcagctggtgcagtctggaggtgaggtgaagagcctggggcctcagtgaacgtctcctgcaaggcttcgtggttacagtctttaccgactatggtatccacgtgggtgacgacgacggccctggaccaaggacttgagtttcgggagttggggatagggatcgacggtacccttaagttaatcggtaaacacgtaaaggtatacgaccaaccggaacgtccgtacccgaggggacaacgacgttcctaccgatacggaaccaacgacggaacacgaactacccgacgaaccgacaacgaaacctagtaacctaagtagggtaattagggaacggtacgtccgtaaggtacgtaacgttaccgtagaacccggaacgacccgggtaccctagttacgttaacgttacgttggttacgagggtacgggtcgtacgaacgtacgaacgacggtcggggactacgggacctgtacnccgtacncgtcaccg

SEQ ID NO: 148926 - DNA, 976 bp, Homo sapiens
  misc_feature: GYAE6OF01A44SI.26.72.G06.1.454.CMB.1.raw
tcagagactatactcacgaccggtgctcgatttagctacgactgcaagggaaagggacccaaaaaccacacccctccttgggagaatcccctagatcacagctcctcaccatggactggacctggagcgttccttttcgttggtggcagcagcgacaggtcgccactcccaggttcagctggtgcagtctgggaggtgaggtgaaggaacgtccgtggggcctcgtagtacgtaaccgttctaccgtgacgtaacggtcctttcgtacggttaaccgtacggttccgtttaaccccgtaagttagttaccgggttaacttacccgtaaccgggttggggttaccgaccgggtaaccggtacccgggtcccgttaggggaaacccgtaaagggtaccgttagggaaggggttagggtacgggtaggggttaacggtacgggacttaccgtaaccggttaccctttaagtaaacgttacgggtaaaaccgtaaggtaaaggtttacacggtaccctaaaccggaaacgccgtaacccgggacggaccgtaaacgtaccgttacccaaccgttaacgggacccaaaacccgaacgtaaaccgaacccgaaccgtaaccttacccgaaaacccgggttccgaaaccccttaaaactaaacccgtaaaccggtttaaaccgtaacggttaaacgggtaaacgggtttaaccggaagggtaacccggtaccgtaaagggtacccggtaacgtaaccgggtaacggaaacccggtaaccggtacccggagtttaaaccgttcggttaaacccgtttagggtttaccggtaacgggttaacggggtaacccggggttaacggtaacgaaccggttaaacccggaacggtaacggggttacccggggaaccccgtaaaccccggggttaaccgtccgggttaaccccgtaccggtttaccccgttccgaaccccggttaccccgg

SEQ ID NO: 148927 - DNA, 813 bp, Homo sapiens
  misc_feature: GYAE6OF01CNRDH.26.72.G06.1.454.CMB.1.raw
  modified_base (234)..(234): a, c, t, g, unknown or other
  misc_feature (234)..(234): n is a, c, g, or t
  modified_base (753)..(753): a, c, t, g, unknown or other
  misc_feature (753)..(753): n is a, c, g, or t
tcagagactatactcacgaccggtgctcgatttagctacgactgcaagggaagggcagcaagatggtgttgcagacccaggtcttcatttctcttgttgctctggatctctggtcgcccggcgggacagtcgtggatcgaccctagtctccagcctccctggctgtgtctcgtgggcgaggacggtcccaccgtatccaactgactaacgtccagcctaggtagtttgttttanaaccgtacggtcccgaaactaaagtaaacgaacttacgttacgcgtttacggtaaccagtaaccgaaacgaaaccgaacggtaccacggtccccttaacctttaactaccttaaccttcgtaaccgttttacccggtccgggggtaccccttacccggttaaaccccgggggtaaacggtttccccggggtacttcccggttcggtaccccgttaagttttccgacgggttccgaccggtacgggttccggggttaccgtacgggaacctaacgggtagtttaccctaaccgtttccctaccaacctaacgtccgaacgccgtacgcccgtagccgtaggtaccgtaggtaacgtgttaggtcgttacttagttttacctacgttcgtcgtaagtacttaaggttttcgtttaccggtcgttacccgtccgtttacgttaacggtttccggacccgttaccggggtaaccgtacgggttaggacgtaacgtacgtaacggacgttaacgttcggacgtntacccggaccaaccgtctttccgttaccgttaccgttactaccctccgttacccgtaccg

SEQ ID NO: 148928 - DNA, 642 bp, Homo sapiens
  misc_feature: GYAE6OF01EL6SA.26.72.G06.1.454.CMB.1.raw
  modified_base (296)..(296): a, c, t, g, unknown or other
  misc_feature (296)..(296): n is a, c, g, or t
tcagagactatactcacgaccggtgctcgatttagctacgactgcaagggaagggcagcaaggatggtgttgcagacccaggtcttcatttctctgttgctctggatctctggtgcccgcggggacatcgtgatgacccagtctccagactccctggctgtgtctcgtgggcgaggaggccaccatcgaactgcaacgtccagccaggtacgttgttttatacacggtccgaactaaataagaacttacttagcttaggtaccagacaagaaaccaggacagcctactaatctacncatttacgtcggcctacgtacccgggtaagtcccggggtctacgtggccgtattcgagtcgaccaggcgggtcgtgggacagtagttcactccgtacacacgtacagcaacgccctggacgtacggctacggaagtagtggtggtactagtttactacgtgtactagtctaaattcgtttcgtacgtcgttacccgtacgttacgttttccggaccgtaccgggtaccgtagggtaggtaacgacgttaccggaacggtaaccggaaccgttgggtacgggtcttacggacccgtaaccgtacgtacgttcggttacctttaccgaaccttccgttccccgtaacc

SEQ ID NO: 148929 - DNA, 630 bp, Homo sapiens
  misc_feature: GYAE6OF01BQXYD.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgttccttttcttggtggcagcagcgacaggtgcccactcccaggttcagctggtgcagtctggaggtgaggtgaagaagcctggggcctcgagtgaacgtctcctgcaagcttcgtggttacagtctttaccgactagtggtactcaccgttgggtcgcgacgacggccctaggaacaaggtcttggagtggagtgggatggatcgacgtccttaagtaagtaggaacacggtaagtatcgaccaacgaacgccgtacggaaggcaacgaccgttccacctaagtaccgaaccaacgaacgaacctacactaccaccgaacgaccaaacgaacaactaacgtaagttaacggtaagttacggaacggtacgtacgtagtaacgtactacgtacgaaccgacgacgcctaagtacgttacttacgtagtacggaagggtcggtacgagacgaacgtagacggtcgggaccgacggacgtcggtacaccgtctccgtcgaccg

SEQ ID NO: 148930 - DNA, 741 bp, Homo sapiens
  misc_feature: GYAE6OF01CSN7O.26.72.G06.1.454.CMB.1.raw
  modified_base (111)..(111): a, c, t, g, unknown or other
  misc_feature (111)..(111): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
  modified_base (497)..(497): a, c, t, g, unknown or other
  misc_feature (497)..(497): n is a, c, g, or t
  modified_base (656)..(656): a, c, t, g, unknown or other
  misc_feature (656)..(656): n is a, c, g, or t
  modified_base (705)..(705): a, c, t, g, unknown or other
  misc_feature (705)..(705): n is a, c, g, or t
tcagagactatactcacgaccggtgctcgatttagctacgactgcaagggaaggcagcaagatggtgttgcagacccaggtcttcatttctctgttgctctgatctctggngcccgcggggacatcgtgactgaccctgtctccagtcctcctggctgtgtctcgtgggcgagacggccacctancaacngcaagccaagcctagtgttcttttanacgacggtaccaactaagaataaccttagttacgcgtttagaaccaggacaagaaaccnggtacacgccttacaatctacctcgtactcgtcgtcctacggtaccggtacggttccgcttcgtcggacctagttcgaacgtcgtaccggcgtttcgggaccgaggtaacgtacggtccctctactacccggcaactcggacacggctaccctgacgttacgccgttaggaggtaacgtgggttacgacggttaccgtttaaattacccgtgggttttaacnccgggtttaataacgtttaacgttaccggtttccgtacgtaaccccgttttgtaaacccgtttttcggtaccgggaaacccccgggtaggttaccgggaggtacggttaaccgtcccgaagggttaaacggaccgtttaccggcgggtaaccgggtttnaccccggggaactttacctctttaaaccgggggtttccttaaacccttnttttaaacccccggccccgttttccccggtaaacgg

SEQ ID NO: 148931 - DNA, 681 bp, Homo sapiens
  misc_feature: GYAE6OF01A2IJU.26.72.G06.1.454.CMB.1.raw
  modified_base (292)..(292): a, c, t, g, unknown or other
  misc_feature (292)..(292): n is a, c, g, or t
  modified_base (367)..(367): a, c, t, g, unknown or other
  misc_feature (367)..(367): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagagccgtggggcctacgagtacgacgttctccgtgcgaaggtcttctggttactagtcctttaaccgactagtgtatcaccgtgggtcncgacgacgccctaggacaggtactgagtgagtggatggactcacgtccttaagtagtaggtaacaacgtaagtanaccgaccgaaaccggaacgtccgtaccgacgggtaccaggtacctcctacgtagtaccggaccacgaacgaccaacgtaccgtaccgaacgacgaactaacaaacgtactaacgagtaacgtaagttacgacgggccttacgacggacgtactacgtacgaaccggtacgtacccggaacttagtagtttaccgttaacgtggttaaccggaaggggtaccgggttaacgacggtaacccgaaggtaccgggtacggtccgggaacccgggtacggacccgttcggacccttacccgtcctccgacgtaccccg

SEQ ID NO: 148932 - DNA, 657 bp, Homo sapiens
  misc_feature: GYAE6OF01DCBB4.26.72.G06.1.454.CMB.1.raw
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgttccttttctggtggcagcagcgacaggtgcccactcccaggttcagctggtgcagtctgggngtgaggngaagagcctggggcctcgagtgaacgttctcctgacaggnttcgtgttacagtctttacgctagtggtatccacgtgggtcacgacacggccctaggacaaggtacttagaggtggagtgggtaatggatcgacgtcccgtttaataagtacggtaaacacggtaaagtatacgacgtaaccggactacgtaccggaagggtacaacggtacctacgttacccaagccgaacctaacgaacgaaccttacgactacccgaagacgaccaaacgtaacactaactaacggtagtaacgttaggaggtacgtccgtagaacgtagtacctacgggaactacgaccggtaacctattagttaacttacgtgtaacgaacggtagggtagtaacgacgtaacggaacacggtcgggaaccgaggtaaccgtcgtacccaccgttccgtccgtcgtaacccg

SEQ ID NO: 148933 - DNA, 685 bp, Homo sapiens
  misc_feature: GYAE6OF01BENDI.26.72.G06.1.454.CMB.1.raw
  modified_base (243)..(243): a, c, t, g, unknown or other
  misc_feature (243)..(243): n is a, c, g, or t
  modified_base (597)..(597): a, c, t, g, unknown or other
  misc_feature (597)..(597): n is a, c, g, or t
  modified_base (608)..(608): a, c, t, g, unknown or other
  misc_feature (608)..(608): n is a, c, g, or t
tcagagactatactcacgaccggtgctcgatttagctacgactgcaagggaagggacccaaaaccacacccctccttgggagaatcccctagatcacagctcctcaccatggactggacctggagtcgtaccttttcgtggtgcagcagcgacgaggtcgcccactcccgtaggttcagtcgtggtcgctagtcgtgggaggtgaggtagaagacgccgtgggcctgagtgaccgtctaccgngaccgtaggtccttcgtagtacacgtccttacgctagtcgtatcgtacgtgggtcacgacgtcgcctaggactaggtactgacggtagagtgggtataggactcgacttaccgttaagtagtacggtaaaccagtaacgtcgtaccgaccgtaacggtacgtcccgacggtaagaccgtacgtacctacctaccgtagtaccaaccgacgtaacgacctaaccgaccgacccgtaacggactaacgaacccgaaactacgtaacgtacggtaggtacgtacggaagtacgccgtaggactacgtacgaacgtaccgacggtaccagtacttacggttacgtcgttacgggacgnggttaaccggngtacgaacctacgaacggtcggtccggaacgtacccggttacggtaccctcgtaccccgcgttacccgcgtaccccg

SEQ ID NO: 148934 - DNA, 514 bp, Homo sapiens
  misc_feature: GYAE6OF02H03DY.26.72.G06.1.454.CMB.1.raw
  modified_base (420)..(420): a, c, t, g, unknown or other
  misc_feature (420)..(420): n is a, c, g, or t
  modified_base (459)..(459): a, c, t, g, unknown or other
  misc_feature (459)..(459): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaaataagaactacttagcttggtaccagcagaaaaccaggacagcctcctaatctactcatttactgggcctctacccgggaatccggggtctctggccgattcagtgccagcgggtctggacagagttcactctcaccatcagcagcctgcaggctgaagatgtgctagtttatactgtcagcaattattttcgngtctccgtactacttttggccaggggacccaggtggaanacgtacagacgtaactggtcggctcgcaccatctcgtcttcattccttcccgtcc

SEQ ID NO: 148935 - DNA, 548 bp, Homo sapiens
  misc_feature: GYAE6OF02G5VXE.26.72.G06.1.454.CMB.1.raw
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctcgtggccgattcagtgccagcgggtctgggacagagttcactctcaccatcagcagcctgcaggctgaagatgtggctaggtttattacgtgtcagactaattagttttcgtgtccttccgttaacttaccgtttttcgggacccgtaacggggtaccctagggttggagagtcgagacgtaactggtcggactgccaccattcttcgttcttctacttccttcccgtacc

SEQ ID NO: 148936 - DNA, 497 bp, Homo sapiens
  misc_feature: GYAE6OF02G0JVO.26.72.G06.1.454.CMB.1.raw
  modified_base (475)..(475): a, c, t, g, unknown or other
  misc_feature (475)..(475): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctcgtggccgattcagtgccagcggtctgggacagagtcatctcacatcagcagcctgcaggctgaagatgtgctagttattactgtcagcaatatttcgtgtctccgtacacttttggccaggggacccagggtggagatcagacgatggtgctgcactanctcgtcttcacttcctccgtcc

SEQ ID NO: 148937 - DNA, 528 bp, Homo sapiens
  misc_feature: GYAE6OF02IWT32.26.72.G06.1.454.CMB.1.raw
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggcccctggacaaggacttgagtggatggggatggatcagcccttataatggtaacacgaagtatgcaccgaagctccaggcagactctcatgaccacacgacacactccacgagcacaacatacatgaatgagagctgnganctgacgacacgcatagtattacgtgttcgagtacgggtacgtgacgaacggaacaacgtggggaccaacgggaccctcggtaccaccgtctcctcgtaccg

SEQ ID NO: 148938 - DNA, 548 bp, Homo sapiens
  misc_feature: GYAE6OF02GFBM0.26.72.G06.1.454.CMB.1.raw
tcagagactatactcacgaccggtgctcgatttagctacgactgcaagggaagggcagcaagatggtgttgtagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcggtctgggacagagtcactctcacatcagcagcctgcaggctagaagatgtgctagtttattactgtcagtctaattatttcgtgtcttccgtactacgttttaggcccgtaggggaccctagggtcgtacgagtacgagacgaacgttgtacggctacgccaaccgtagttcttacggttccttacctacgtttcccttccccgtactaacg

SEQ ID NO: 148939 - DNA, 564 bp, Homo sapiens
  misc_feature: GYAE6OF02I1HFH.26.72.G06.1.454.CMB.1.raw
  modified_base (389)..(389): a, c, t, g, unknown or other
  misc_feature (389)..(389): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctcgtggccgattcagtgccaggcgggtctgggacaggagttcactctcaccatcagcagcctgcagctgaagntgtgctagtttattactgtcagtctaattacgttttcgtcgtccttccgttacttaccgttttcggccgtacggggtaccctagggtacggagacgtacgacgtacgaacgtcggtcggtcctacgtcctacctagttcgttcgttaccttcgtacttcccgttaccccgtaccg

SEQ ID NO: 148940 - DNA, 601 bp, Homo sapiens
  misc_feature: GYAE6OF02I2AU3.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcaagaaaccaggacagcctcctaatctactctatttactcggcctcgtacccgggaagtccggggtctcgtcggccgtattcagtcgccgaggcgggtctgggacagtacgttcactcctacaccatcagcacgcctgcaggctagaagatggtggctagtttattacgtgtcatctaatttctttcgtgtccttaccgttacttacgttttcgggaccgtacggggtacccgtagggttacggacgtaacgtacgaacggtacgtaacgttcggtcgggtacctacggaccctaccgtacgttaccgttcgttcccgttacctaccgtttccccgttaccccgtacccg

SEQ ID NO: 148941 - DNA, 535 bp, Homo sapiens
  misc_feature: GYAE6OF02JH5GU.26.72.G06.1.454.CMB.1.raw
  modified_base (212)..(212): a, c, t, g, unknown or other
  misc_feature (212)..(212): n is a, c, g, or t
  modified_base (313)..(313): a, c, t, g, unknown or other
  misc_feature (313)..(313): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagaggccacatcaactgcaagtccagccagtagtgttttanacaggtccgacaataagaactacttagcttggaccagacagaaaccaggacagcctctaatctactcatttactggcctcgtacccggaatccgggtctcngccgattcagtcgcagcggtctggacagagttcactctcacatcagcacgcctgcaggctgaagatgtgctagttatactgtcagactaatatttcgtgtctcgttactactttcggaccgtacgggacccaggtcggagtacgtacgacgacgtaacgtggtcgggtactcggtaccaccgtacgttctcggttccttacctacttcccttcccgtaaccc

SEQ ID NO: 148942 - DNA, 605 bp, Homo sapiens
  misc_feature: GYAE6OF02H1Z7P.26.72.G06.1.454.CMB.1.raw
  modified_base (390)..(390): a, c, t, g, unknown or other
  misc_feature (390)..(390): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtcctccagacctccctggctgtgtctcgtgggcgaggagggccaccatcaactgcaagtccagccagtagtgttttatacaggtccgaacaaataaagaactacttagcttggtaccagcagaaaaccaggacagcctacctaatcctaactctaatttactcgggccttcgtaaccccgggaatccgggttctcgtcggccgtattcgagtcgccgaggccgggtcgtagggactagtagttcacttcncacctatacagcagctgcagctgaagtagtgtgctagtttacttacttgtacagtactaatttacttttcgtcgtccttaccgttacttacttttcggaccgtaacgggtacccgtaggtcggaagtacgtacgacgtacgtacgtcggtcggaccttggacctaccgtacgttccgtacgttaccgtttacctacgttcccgttccccgtaccg

SEQ ID NO: 148943 - DNA, 571 bp, Homo sapiens
  misc_feature: GYAE6OF02GTBVH.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggcccctggacaaggacttgagtggatgggatggatcagcccttatatggtaacacgaagtatgacacgagctccgagggcagactctaccatcgaccacacgacacactaccacgagcaacaacatacataggaattgaggagccgtagagtatcgtagaccgacgacggaccatgttattacgtcgttacgaggtacgggttacggtacgacgaacggaacgaacggtcggggaccgacggggaacccgttcgggtaccctaccggtcctacccgtcgtacccgg

SEQ ID NO: 148944 - DNA, 589 bp, Homo sapiens
  misc_feature: GYAE6OF02G0MQC.26.72.G06.1.454.CMB.1.raw
  modified_base (398)..(398): a, c, t, g, unknown or other
  misc_feature (398)..(398): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctcgtggccgattcagtgccgaggcgggtctggacagacgttcactctccaacctatccgagcacgtcctgcaggctaggaaagngtggtggctaagtttattactgtcagtactaagtttattttcgtcgtccttaccgttacttaccgttttcggaccgtaacggggtacccaggggttcggagtactcgaacgtaccgtaacgtgggtggccgttcggacctaacctagttaccgttcggtttacctttctacgtttccgttccccgtaaccg

SEQ ID NO: 148945 - DNA, 528 bp, Homo sapiens
  misc_feature: GYAE6OF02JZF50.26.72.G06.1.454.CMB.1.raw
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
  modified_base (521)..(521): a, c, t, g, unknown or other
  misc_feature (521)..(521): n is a, c, g, or t
tcagagactatactcacgaccggtgctcgatttagctacgactgcaagggaaaggggacccaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttacgactatggtatcacctgggtgcgacaggcccctggacaggacttgagtggatgggatggatcagcccttanatggtaacacgaagtatgacacgaagctcagggcagactcnccatcgaccacagacacagtccagagacacaacatacatagaattgagagcctagagatcagacgtacacgacagttgtattacgtgtcgaagtaggtaggtgaacgacgtaacacggtacgggacacgggacctagggcctaccggcttacncgtaccg

SEQ ID NO: 148946 - DNA, 585 bp, Homo sapiens
  misc_feature: GYAE6OF02F6I77.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagttgtttatacaggtccgacaataagaacttacttagcttggtaccagcagaaaccaggacagcctcctaatctactcatttactgggcctcgtacccgggatccggggtctcgtggccgattcagtgccagcgggtctggacaggagttcactctcaccatcagcagcctgcagctgaagatggtgctagtttatactgtcagtctaattacgttttcgtcgtcttaccgtacttacgttttcgggaccgtacggggtaccctagggttcggaagtacgttacgaggtaaccgtacgttacgggtcggtaccgttaggccctaaccgtacgttccgttcggttaccctttaccgtacgtttccccgttaccccggtaccg

SEQ ID NO: 148947 - DNA, 790 bp, Homo sapiens
  misc_feature: GYAE6OF02JMYTQ.26.72.G06.1.454.CMB.1.raw
  modified_base (293)..(293): a, c, t, g, unknown or other
  misc_feature (293)..(293): n is a, c, g, or t
  modified_base (714)..(717): a, c, t, g, unknown or other
  misc_feature (714)..(717): n is a, c, g, or t
tcagagactatactcacgaccggtgctcgatttagctacgactgcaagggaaagggacccaaaaccacacccctccttggagaatccctagatcacagctcctcaccatggactggacctggagcgttccttttctttggtggcagcagcgacgaggtcgcccacctcccgtacggttcgagcgtggtgcgagtcgtggaggtaggaggtagaagaacgccgtcgggccgtacgtagtacgtaacgtaccgtccgtcgcaaggcgttctggttactacgcttaccgtacgtantaggttaacgttacgtaccgtacgggttacggtaccggtaccgtaacggtaccccgtacgggtaaccgtaaacgggtaaccgtttacggtaacggttacgggtaacggttacggggtaacggttacgggtaacgttaccgtaacggtaacccgtttaacgttaaacgttaacgggttaaaccgtaaaccggtaaacggttaacgttaacgtaaccgtaacccggtaaacgtaaccgtaccgtaacgggtacgtaacgtaaccgtaccgtaccgtaacgtacgtaaccgaaccgaacgaaccgtaaccgtaacgtaacccgtaaccgtaacgtaaccgtaaaccgtaaaaccgtaaacgttaaaccgtaaacgtaacggtaaacgttaacgtaacggaacgtaaccgtaacgtaacgtaacnnnntacgttacggtaaccggtaaccgaaccggtaccgtacgtaacgttaacgttaaccgttacgttacggtaacgg

SEQ ID NO: 148948 - DNA, 520 bp, Homo sapiens
  misc_feature: GYAE6OF02GGXQK.26.72.G06.1.454.CMB.1.raw
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaccaggacagcctcctaatctactcatttactgggcctctacccgggaatccggggtctctggccgattcagtgccagcgggtctgggacaggagttcactctcaccatcagcagcctgcaggctgaagntgtggctagtttattctgtcagctaattattttcgngtcctccgttactactttcggccgtacggggacccagggtgagtaagtcagacgaactggcggtctgcaccattcctgtccttctacttcctcccgtcc

SEQ ID NO: 148949 - DNA, 546 bp, Homo sapiens
  misc_feature: GYAE6OF02GOJ2F.26.72.G06.1.454.CMB.1.raw
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (463)..(463): a, c, t, g, unknown or other
  misc_feature (463)..(463): n is a, c, g, or t
  modified_base (539)..(539): a, c, t, g, unknown or other
  misc_feature (539)..(539): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttaccagtctttaccgactatggtatcacctgggtgcgacaggccccctggacaaggacttgagtggatgggatggatcagcccttataagtggtaacaccgaagtntgcacgaagcctacgagggcagctctccatgaccanacgaccacatccacgacncaacaacatacatgattgaaggtcacctaggagatcgagacgacgacgcatgtactntgtcgagtagggtagtgaaccgacgaactacggtacgggaccgacggtaacccgtggtaccgacccgtcgtccctntacccgg

SEQ ID NO: 148950 - DNA, 502 bp, Homo sapiens
  misc_feature: GYAE6OF02IEO45.26.72.G06.1.454.CMB.1.raw
  modified_base (213)..(213): a, c, t, g, unknown or other
  misc_feature (213)..(213): n is a, c, g, or t
  modified_base (294)..(294): a, c, t, g, unknown or other
  misc_feature (294)..(294): n is a, c, g, or t
  modified_base (489)..(502): a, c, t, g, unknown or other
  misc_feature (489)..(502): n is a, c, g, or t
tcagagactatactcacgaccggtgctcgatttagctacgactgcaagggaaggcagcaagatggtgttgcagacccaggtcttcatttctctgttgctctggatctctggtgcccgcggggacatcgtgatgacccagtctccagctccctggctgtgtctctgggcgagagggccaccatcaactgcaaagtccagccagagttgttttanacaggtccgaacaaataaagaactacttagcttaggtaccagacagaaaaccaggacagcctcctaatctactcatttacnggcctctacccgggaatccggggtctctggccgaattcagtcgccagcggggtctcgggacagagttcacttctcacatcagcagcctgacaggctgaagatgtgctagttattatagtcagctaaattattttacgtgtcttcccgtacgttacttttcggtaccgacgggtaccgtacgggtaggagaacgtnnnnnnnnnnnnnn

SEQ ID NO: 148951 - DNA, 512 bp, Homo sapiens
  misc_feature: GYAE6OF02FL4NX.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgtccttccgtactactttttcggcctaggggaccctagggtcggagatcgagacgaactggtggctgcaccatctgtcttcactctcccgtcc

SEQ ID NO: 148952 - DNA, 578 bp, Homo sapiens
  misc_feature: GYAE6OF02HMH4D.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagttgttttatacaggtccgacaaataagaactacttagcttggtaccagcagaaaccaggacagcctcctaatctactcatttactggcctctaccgggatccggggtctcgtggccgtattcattcgccaggcgggtcgtggacagagttcactctacaccatcagcagcctgcaggctagaagatgtggactagtttacttactgtacagtacaatttacgtttcgtgtccttccgtacttaccgttttcggaccggtacgggggtaaccctaggggttacggaagtacgtacgaggtacgaacgttcggtcggcctcggacctaccgtagttccgttcgttccttacgtaccttccgttaccccgtacccg

SEQ ID NO: 148953 - DNA, 614 bp, Homo sapiens
  misc_feature: GYAE6OF02IXPR0.26.72.G06.1.454.CMB.1.raw
  modified_base (301)..(301): a, c, t, g, unknown or other
  misc_feature (301)..(301): n is a, c, g, or t
tcagagactatactcacgaccggtgctcgatttagctacgactgcaaggggaaaggggcagcaagatggtgttgcagacccaggtcttcatttctctgttgctctggatctctggtgcccgcgggacatcgtgatgacccagtctccagtactcctggctgtgtctctgggcgagaggccaccatcaactgcaagtccgagccagagttgttttacgacaggtccgaacaataacgaactactagcttaggtaccagacaagaaacctaggacacgcctacctaatctactctatttacgngggcctccgtacccgggagtccggggtctcgtggccgtattcagtcgaccaggtcggtcgtggactaggacgttacgactcgtacaacctactcagccgacgtcctgcgaacggtctaagaaagagtggtacggactaagtttaacttactagttacgagtactaagtttcgtttacgtcgtaccttcgtaacttacgtttacggaccgtacggggacctagggtggtacgagtacgacgacgtaacgttcggtagtccgtaggacctaacgtagttccgtacgttccttacctacttcccgttccccgtacg

SEQ ID NO: 148954 - DNA, 576 bp, Homo sapiens
  misc_feature: GYAE6OF02GGWWK.26.72.G06.1.454.CMB.1.raw
  modified_base (174)..(174): a, c, t, g, unknown or other
  misc_feature (174)..(174): n is a, c, g, or t
  modified_base (350)..(350): a, c, t, g, unknown or other
  misc_feature (350)..(350): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagngggccaccatcaactgcaagtccagccagagttgttttatacaggtccgaacaataagaacttacttagcttggtaccagcaagaaaccaggacagcctcctaatctactcattactgggccctcgtacccggaagtccggggtctcgtggccgattcagtcgccgaggcggtcgngggacagtagttcactctcacatcagcagcctgcgaggctagaagatgtggntaggtttatactgtcagtctaattntttcgntccgttcgtacttacgttttcggccgtacgggtaccctagggtaggacgtacgtacgaacggtacgtaacgtggtcggtccgtacggcccgtaaccgtcttcgttcggttccttaccgtaccgtttcccgtccccgtaacccg

SEQ ID NO: 148955 - DNA, 647 bp, Homo sapiens
  misc_feature: GYAE6OF02HTDTQ.26.72.G06.1.454.CMB.1.raw
  modified_base (232)..(232): a, c, t, g, unknown or other
  misc_feature (232)..(232): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagacctccctggctgtgtctcgtgggcgaggacgggccaccatcaactgacaagtccagccagagttgttttacacaggtccganaaataacgtaactacttagcttggtaaccagaccaagaaaccgaggacagcctacctaatcctactctactttacgtcggcctacgtaccgggagtccgggtctcgcggccgtattcgagtcgccgaggtccgggttcgtacgggactagtacgttcaccgtctaccaccatcgacgcacgtcctgaccgtaggtactggaaagtacgtggtgtaccgttagtttactacgtgtcgaacgtactaatttcttttcgacgtccctttacgttaacctttacgtttccgggaaccgtacggggtacccgtagggtaggaacgtaacgtcgaacggtacgtacgttacgggcggtacctggaccctaaccgtcgttaccgttgtttcccgttactaccgtttccccgtcccgtaaccg

SEQ ID NO: 148956 - DNA, 815 bp, Homo sapiens
  misc_feature: GYAE6OF02GCPJC.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatccgtgactgacccagtcctccagacctccctggctgtcgtctcgtgggcgagacggccaaccatccaactgacgaacgtccagcccagacgtttcgttttacaccgtacggtcccgaactaactaaacggtaaaccttaccgttaacggtccttacggggtaacccaacgaccaaacggaaaacccgacgggaaccaccggtaccccttacctaaacttccttaacctctacttttaaccgcgggtacccttccgtaacccgggtaagttccccgggggttcttacgtccggggtaccccgtaattttccgaacggttccggaccccgtaacgggtcccggggttactacgggggtaactacgggttacgttccaaccgttaccgtacccacccgtaatccgaacgccacggtccctggaccgtaacgggtcctaggaacgtaacgtcgttacgggtaccttaacggtttactaccgtacggtactaacgacctttaaagtttccttttcgggcttcccgttaaccgttaccttaaccggttttcgggacccgtaacggggtaacccgttaggggtaaccgacgtaactaccgtaacggacccgtaacgtcggtaacggtccgtacggtacccctaccggtaaccttccggtacttccctacttacccgttacccgttccccgtaccg

SEQ ID NO: 148957 - DNA, 641 bp, Homo sapiens
  misc_feature: GYAE6OF02G7HWN.26.72.G06.1.454.CMB.1.raw
  modified_base (228)..(228): a, c, t, g, unknown or other
  misc_feature (228)..(228): n is a, c, g, or t
  modified_base (278)..(278): a, c, t, g, unknown or other
  misc_feature (278)..(278): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctcgtgggcgaggacgggcccaccataccaaccgtgacaaggtccagccaaggagttgttttanacaggtccgaacaataagaactacttagcttggtaccagacaagaaaccnggacacgtcctacctaatctactctaactttacgtcgggcctccgtacccgggtaagtcccggggtctcgtcggccgtattcgagtcgaccgaggtcgggtctagggacaggtacgtcactcctacaccatcgacgcacgccgtgccgtggactaggaagtgtacgggtgtacgttagttaacgttcctaggttacaggtacttaaagtttcgtttcggtctacgttccgttaacgttacggtttccggaccggtaggggtaccccttagggcggtaacgacgtacgaacggtacgtaacggtcggtcggtactcgacccgtaacctgtacttcggttacctactcttcccgtacccgtaccg

SEQ ID NO: 148958 - DNA, 715 bp, Homo sapiens
  misc_feature: GYAE6OF02FKMOB.26.72.G06.1.454.CMB.1.raw
tcagagactatactcacgaccggtgctcgatttagctacgactgcaagggaaaggggacccaaaaaccacacccctccttgggagaatcccctagatcacagctcctcaccatggactggacctggagcgtccttttcttggtggcagcagcgacaggtgcccactcccaggttcagctggtgcagtctggaggtgaggtgaagaagccgtggggcctcgagtgaacgtctcctgcaaggcttctggttacagtctttaccgactagtgtatcacctgggtcgcgacaggcccctggacaagggtaccttaggagtcgggaatcggggaagtgggatacgaggtccctttaataagtacggtaaacgaacgtaaaggttagtacgaccgtaaccggaagtccgtaccggaacgggactaggaccctccgtaccgattacggaccctaacgaacgaacacctacgacccgaacgtaacggaccaaaccctaaacaactaaccgtaagttaacggaagtttaggaagggtacggtacttacggacgtacgtacgtacgaccgacgtaccggaccgtagttagttactacgttagttcggtagggtacgggttacggtacggtaccgaacggtaaaccgaacgggttacccggggaaccggtaaccgggtacccggttccggtaacccgtaccggtaccggtccctacgtaaccccgg

SEQ ID NO: 148959 - DNA, 964 bp, Homo sapiens
  misc_feature: GYAE6OF02GH1OJ.26.72.G06.1.454.CMB.1.raw
  modified_base (219)..(219): a, c, t, g, unknown or other
  misc_feature (219)..(219): n is a, c, g, or t
tcagagactatactcacgaccggtgctcgatttagctacgactgcaaggggaaagggggcagcaagatggtgttgcagacccaggtcttcatttctctgttgctctggatctctggtgcccgcggggacatcgtgatgacccagtctccagactccctggctgtgtctcgtgggcgagagggccaccatcaactgcaagtccacgccagagttgtttanacgaggtccgaacaataaagtaaccttacgttagcgttacggtaccaggacaacgaaaccaggacacgtccctaccgtaactccttaacttctaactttaccgtggggtaccccttaccgtaacccgggtaagttaccccggggggttactccggttcggacccggtacgttacgtacggttcggacccgtaggtaccggggttccgtacggggaaccaggttacggtttacctaccggttacctacgaaccgtacgttaccgaacggtactaacccggccgtttaccgaccggtaaggtaccgttacgggaaaaggttacgttagggttaccggggtaaccgttttaaggtttaaacgttttaccccggtaaggtttacccggtaaacggtttaacccgtttaaaagtttttaaccgggttttttacccgtaccgggtttaaacccttttcccccgggttaaacggtttttacccgggttttttaaccggggacccccggggttaaacggggggggttttaccccctaaagggggggttttacgtaaaaccggggttccttaaaaccggggtacgggtaaaccccggtttaaacgggttacggggggtttaaacccggtaacccggggtttacctaaaccccggttaaaccccggtttacgtttaaccccgggttttaccgttttaccggttttaaacccccgtttacggtttttacccccccggttcccccggttaaaccccg

SEQ ID NO: 148960 - DNA, 652 bp, Homo sapiens
  misc_feature: GYAE6OF02HFHYG.26.72.G06.1.454.CMB.1.raw
  modified_base (217)..(217): a, c, t, g, unknown or other
  misc_feature (217)..(217): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctctgggcgagacgggccaccatcaactgcaacgtccagccagagttgttttaanacgaggtccgaacaaataacgaaaccttacttagcttcggtaccagacaagaaaccgaggaccagcctacctaatctactctatttacgcggcctcgtaccggtagtccgggtctcgtcggcgtatcgagtcgaccncggcggtcgtaggacagtacgttcacttcncaccatccagtcacgcctgacacgtcgtagaagagtggtacgtacgttagtttaacttacgtcgtacgtaacgtacttaacgtttacgttttaccgttcgtccttaccgttaccgttacgttttaccgggacccgtacggggacccgttaaggggtacggtaacggtacgtaccgaaccggtacgtaacgttggtaaccggtcgtaccggaccctacccgtacgtttcccgttagttccgttacctaccgttcccgttacccgtaccc

SEQ ID NO: 148961 - DNA, 579 bp, Homo sapiens
  misc_feature: GYAE6OF02HQF7V.26.72.G06.1.454.CMB.1.raw
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtcctttttcttggtggcagcagcgacaggtgcccactcccaggttcagctggtgcagtctggaggtgaggtgaagagccgtggggcctcgaggtgaacgttctcctgcaaggcttctgttacagtctttaccgactagtgtatcgacgtggtgcgacgacggcccctaggacaaggcttgagtggagtggagtggactcgagtcccttataacgtggtaacacggtaagtagtacgacaaccgacgactacgaggacacgactcctcatcgaccacgagacacactaccagacncacaacatacngtagatagagagcgtagagatcgagacgacgacggactagtcgtattacgtgtaacgtagacgggtacggtacgaacgaacgacgaacgggtacgggaccggaacggtaccggtcggtaccctaccggtacctccgtcgacccg

SEQ ID NO: 148962 - DNA, 692 bp, Homo sapiens
  misc_feature: GYAE6OF02GWY02.26.72.G06.1.454.CMB.1.raw
  modified_base (251)..(251): a, c, t, g, unknown or other
  misc_feature (251)..(251): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgttccttttcttggtggcagcagcgacaggtgcccactcccaggttcagctggtgcagtctggaggtgaggtgaagagcctggggcctcgagtgaacgtctcctgcaaggtcttctggtacngtcctttaccgactatgtatctaccgtgggtgcgacgacggcccctggacaaggcttgagtggagtgggatggatcgagtccttataagtggtaacacgtaagtatgcaacggagcctaccgaagggccaacgacctctccgactacgaacccacgtaaccgaacacctaacctacccgaaccgacgaccgaaaccaaacctacttaaccgaagttacggtaaagttacgggaaacgggacgtacccgtaggacgtacgtcgttacgaaccgacccgaacggtcccgttaatacggttaactttacggttcggttaccggaacggggtagggttaccggtaggaacggtaacgaaccgtaacgggttacggggacccgtaaccggggtaaccccgtcgggttaaccccgttacccggtaccgttacccgtccgtaacccgg

SEQ ID NO: 148963 - DNA, 735 bp, Homo sapiens
  misc_feature: GYAE6OF02GOL6I.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggacgaggacgggccaccatacaactgacgaacgtccagcccgagtaggttagttttaacacgtacggttaccgaactaaagttaaacggaaacttacgtttacgtaccgtttacggtaacccaggtaccaaacgaaaacccgaacggaaccaacggtaccccttacctaaacgttcctaacttaccttaacttttaccgtcgggtacccttaccggtaacccggtaacggttacccggggttcctcgtacggccgtacgttacacggtcgacccgtaggtaccgggtcgtacggacgtaacgttacggtacctacgttctacctaccgtatcagacgacgtccgtgacgtaggctaggaagtgtggtagtagttacgtttattacggtacgtcacgtacttaagtttcgtttccgtacttccgttacgttacgtttacgttcgggaccggtacggggtaaccgtaggggtacgtacgagttacgacggtacgtacgtaggtccggtagtccgaccgaccttacgttccttacgttacccgttaccgtaccttcccgtaccgtaccg

SEQ ID NO: 148964 - DNA, 642 bp, Homo sapiens
  misc_feature: GYAE6OF02FUCL7.26.72.G06.1.454.CMB.1.raw
  modified_base (181)..(181): a, c, t, g, unknown or other
  misc_feature (181)..(181): n is a, c, g, or t
  modified_base (533)..(533): a, c, t, g, unknown or other
  misc_feature (533)..(533): n is a, c, g, or t
tcagagactatactcacgaccggtgctcgatttagctacgactgcaagggaaaggggacccaaaaaccacacccctccttgggagaatcccctagatcacagctcctcaccatggactggacctggagcgtcctttctggtggcagcagcgacaggtgcccactcccaggttcagctggtncagtctggaggtgaggtgaagaagccgtggggcctcgagtgaacgtctccgtgcaaggtcttctggttacagtcttaccgattactggtatcaccgtgggtcgcgacgacggcccctaggacaaggccttagagttgggagtggggagtgggactacgaacggtccctttaataagtggtaaaccaggtaaagttagtgaccaaccggaagtccgtaccggaggggacctaacggtacctccgtaccctagtaccgaaccaacgtacgaaccacgtactacccgacgtaacgacctaacgaaactactaaccaagtacggaaagttacggaaggtaccggccgtagaacgtntacgtcgaacgaccgacgccaattcgtattactgtcgagtaggtcgtagacgacgaacgtaccggacgggaccgacggtacccgtaggtccaccgtctaccgactaccg

SEQ ID NO: 148965 - DNA, 728 bp, Homo sapiens
  misc_feature: GYAE6OF02HS3EP.26.72.G06.1.454.CMB.1.raw
  modified_base (223)..(223): a, c, t, g, unknown or other
  misc_feature (223)..(223): n is a, c, g, or t
tcagagactatactcacgaccggtgctcgatttagctacgactgcaagggaagggcagcaagatggtgttgcagacccaggtcttcatttctctgttgctctggatctctggtgcccggcggggacatcgtgatcgacccagtctccagacctccctggctgtcgtctcgtgggcgaggacggccactatcaactgacaacgtccagccagtagttgttttanacgtcggtaccgaactaaataacgtaaacttacgttaggtcgtttacggtaccagaccgaaacgaaaaccgacggacaccgtacccttacctaaacttcctacttactaagttttaccgtcgggtacccttccggtaacccggggtaacgttcccggggtctcggtcggaccgtagttcgacggtccgcgtacgggcgggtacgtcggaccgtagtacgttacaccttcctacaaccgtatacgacgacgacgtctcggcgtaggtcgtaaggaagtgtacgggtgttacgtttaacgtttacgttactacggtacagttaacaacgttaataacccgttacggtcccggtacctcccggtacttaccggttaccggttaccgggaaccgggttaacgggacgtacgggttaagaaccgtacgtaaccgtaaacggtacgtggttacgtaccgaacgtaccctacgtacgttcgttaccgttctaaccgtcccgttcccctaccg

SEQ ID NO: 148966 - DNA, 593 bp, Homo sapiens
  misc_feature: GYAE6OF02F4GKA.26.72.G06.1.454.CMB.1.raw
  modified_base (181)..(181): a, c, t, g, unknown or other
  misc_feature (181)..(181): n is a, c, g, or t
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
  modified_base (521)..(521): a, c, t, g, unknown or other
  misc_feature (521)..(521): n is a, c, g, or t
tcagagactatactcacgaccggtgctcgatttagctacgactgcaagggaaaggggcagcaagatggtgttgcagacccaggtcttcatttctctgttgctctggatctctggtgcccgcggggacagtcgtggatcgaccctagtcctccagacctccctggctggtctctcgtggggnaggcgggcccactactcgaacctganaacgtccagcacgtgttgtttanacnggtccaacaataagaccttnttaaggcctttcggaacctagacaacgaaactaggacacgacctacctaactctaactcgtaacttacgtcggtcctaccgtacccggaacgtccggtccgtccgtcggtacgattcgagtcgcagccggtgtcggactagtatcgtaactcaccacgncgtaagcacggtcncgngacgtngagatcgtgcgttattacctcgtanacgtntacgtattattcgttanctaccgtnttacccgcgtcgacgggtccgaggtcgacgnacgtgacgtcggacgtcgtaccgcgtacaactacgtacgtttcttaccgttccacgttccttcccgtacccg

SEQ ID NO: 148967 - DNA, 857 bp, Homo sapiens
  misc_feature: GYAE6OF02I6YZS.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccgcggggacatcgtgatcgacccagtcctccagacctcccgtggctgtcgtcgtcgtgggcgaggacgggcccacctataccaactgacaacgtccgagccagtagtttagttttaactaccgacggtacccaactaaagtaaacgaaccttacgttaacgtctttacgggtaaccacgacaaacggtaaacccgaggaccaccggtacctaccgtaaccttccttaacctacttaactttaccgtacgggtcccttaccggtaacccggggtacgtcccggggttacctcggtacggtaccgtattaccgacggttcgaccgacgggtccgggtacgtacgggacgtaggtacgttccgaccttccgtacctaaccgtacgtacccgacgtacccgtacggtcccgtacggaccgtaacgggtcgttaaagaaacggttcgttacgggtacggtaacttttaacggtttaaccgttacgtaccggttaacgtaaacgttccgtttaaacgtttaccggttttcccgtaccggtttacccgtttaaacccgggtttactttacccgggttttaccgggacccgggttaccgggtaacccgtagggttaacggaaccttacggtaaccggtaacggtaccgttaaggttcgggaacccggtttacgtacccgaaccgttaccggtacctttcgtttaccggttcccttaaccggtacccgtttaccccgttacccgttaccg

SEQ ID NO: 148968 - DNA, 736 bp, Homo sapiens
  misc_feature: GYAE6OF02F8DAN.26.72.G06.1.454.CMB.1.raw
tcagagactatactcacgaccggtgctcgatttagctacgactgcaagggaagggcagcaagatggtgttgcagacccaggtcttcatttctctgttgctctggatctctggtgcccggcgggacatcgtgatgacccagtctccagacctcctggctgtgtctcgtgggcgaggacggccacatcaacgtgacaacgtccagccagtagtttagttttacacgacggtaccaacgaaataacgaacttacgttacgcgttacggtaaccagacgaaacgaaaccgaggacacgtccttaacctaactcctacgtcttaactttcggcgggtacccttccggtaacccgggtacgttcccggggtcttcggacggtaccgtacttacgacggtcgaccgtagggtccggttacggtagggaacctaggtacgttaccacgtttcccgtaaccctaacgtactacctacggccctacggccctaggaccgacggacgttaggaacgttgtacgggttacgtacgtttaacgttaacttaccggtcgttaacgaacgttaccgttaatttcgtttaccgtcttacccggttaaccgttacgttacggtttccggaaccgggtaccgggttaacccgtgggttaacgaacgttaaccgtacgacgtaccgtacgtcggtacgccgtaacgtcccgtaacgtcttcgttcgttacctacttacggttccctccgtaaccg

SEQ ID NO: 148969 - DNA, 789 bp, Homo sapiens
  misc_feature: GYAE6OF02JX3P6.26.72.G06.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagagactatactcacgaccggtgctcgatttagctacgactgcaagggaaaggggacccaaaaaccacacccctccttgggagaatcccctagactcacagctcctcaccatcggactggacctggagcgttccttttcttggtcggcacgcagtcgacagggtgccccgtactcccgtaggttccaggtcctggtcgcgcgtcgtgggaggttagacgggtgaacgaacggtccgttacggggcccttgtaaggtggtaaccgttcctcctggaccaacgggtcttacgtggttaacncgtctttaccggactgtacggtatccgacgtcggggtacncgaacnccggccccgttaaggacccgttaaggctttggaacggttcgggaacgttcgggatcggtaacttcgaacgttaccctaagttacgtacggtaaaccgacgttaagtacgtcgacgtaccgagtactcccggagactacgnttaccncggtaataccggagtaccgataacacgcgtacggtacacccgtacaactaacggtactacgtaaaggtcgtaaacgttccggaggttaacgccgtacggtaaattcggaacgttacgaaaccgggcggttacccgaattcggttagttaaccgttcgtttacggaccggggttacgtacggggttaaccgcgttaaaccgaccggaacggttacccgggtaccgggtttaacccaacgggtaacccggttaccgggtacctaaccgggtccctttaccgtaccccgttaacccggg

SEQ ID NO: 148970 - DNA, 736 bp, Homo sapiens
  misc_feature: GYAE6OF02F5LBK.26.72.G06.1.454.CMB.1.raw
  modified_base (216)..(216): a, c, t, g, unknown or other
  misc_feature (216)..(216): n is a, c, g, or t
  modified_base (380)..(380): a, c, t, g, unknown or other
  misc_feature (380)..(380): n is a, c, g, or t
  modified_base (578)..(578): a, c, t, g, unknown or other
  misc_feature (578)..(578): n is a, c, g, or t
tcagagactatactcacgaccggtgctcgatttagctacgactgcaagggaagggcagcaagatggtgttgcagacccaggtcttcatttctctgttgctctggatctctggtgcccgcggggacatcgtgatgacccagtctccagactccctggctgtgtctcgtgggcagaggccaccatcaactgcaagtccagccagtagttagttttaanacgtaggtacccgaactaagtaaagaaacctacttaggcctttaggaaccctgacaacgtaaacacggaccagccctacctaactcgtaacttctatttaccgtgggccttactacccgggtaagttcccgggtctcgtcggcccgtaattctacgtcgtaccncgggtcggggtacttagggggacctagggtaactttacgaccctttaccgcctaaacccgtcttaccgacgtacccgacggtttaccccgcggacccgtagggacccgttaggtaaaccggtagttacgggtaggtaacccggttaagttttaaccgtaccgttacgtaccgtaagtaaccgttaatttacgtttacngttaccttaccggttacttacggttccgtcgggtaacggtacccgtagggtacggtaagtacgtacgtaccgtaaggttaccgttggtaccggtccgttccggaacttacgaacgttccgttacggttcccttaccgtccttacccgtttaccgaccc

SEQ ID NO: 148971 - DNA, 151 bp, Homo sapiens
  misc_feature: GYAE6OF01CW92F.1.68.G02.1.454.CMB.1.raw
  modified_base (151)..(151): a, c, t, g, unknown or other
  misc_feature (151)..(151): n is a, c, g, or t
tcagacgagtgcgtcacgaccggtgctcgatttagtcgatagtgaagggaaggaccaaggtggaaatcaaacgaactgtggctgcaccatctgtcttcatcttcccgccatctgaacgcactcgtctgagcgggctggcaaggcgcatagn

SEQ ID NO: 148972 - DNA, 173 bp, Homo sapiens
  misc_feature: GYAE6OF02GKPK6.1.68.G02.1.454.CMB.1.raw
  modified_base (155)..(173): a, c, t, g, unknown or other
  misc_feature (155)..(173): n is a, c, g, or t
tcagacgagtgcgtcacgaccggtgctcgatttagtcgatagtgaagggaaagggaccaaggtggaaatcaaacgaactgtggctgcaccattctgtcttcatcttcccgccatctgaacgcacgtcgtctgagcgggctggcaaggcgcatagnnnnnnnnnnnnnnnnnnn

SEQ ID NO: 148973 - DNA, 153 bp, Homo sapiens
  misc_feature: GYAE6OF02II8YH.1.68.G02.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtcgatagtgaagggaaagggaccaaggtggaaatcaaacgaactgtggctgcaccatctgtcttcatcttcccgccatctgaacgcactcgtctgagcgggctggcaaggcgcatagn

SEQ ID NO: 148974 - DNA, 398 bp, Homo sapiens
  misc_feature: GYAE6OF02HKS1D.1.68.G02.1.454.CMB.1.raw
  modified_base (367)..(398): a, c, t, g, unknown or other
  misc_feature (367)..(398): n is a, c, g, or t
tcagacgagtgcgtcacgaccggtgctcgatttagtcgatagtgaagggaaagggaccaaggtggaaatcaaacgtgagtagaatttaaactttgcttcctcagttgtctgtgtcttctgctccctgtgtctatgaagtgatctataaggtgactctgcaatcagcctctgacgtccttcagggaagaaataaagataagtctgcaagtaaaactcgagaattgattgcacattcttcttgacgagcaagcaagattcagtcagttgggaactgtggctgcaccatctgtcttcacttcctccccgcactcgtcgaaccgtcacttcgtctggcggcgggtctgggaccgtaaggcgactagtacgnnnnnnnnnnnnnnnnnnnnnnnnnnnnnnnn

SEQ ID NO: 148975 - DNA, 316 bp, Homo sapiens
  misc_feature: GYAE6OF01CKFFM.11.56.F01.1.454.CMB.1.raw
  modified_base (306)..(316): a, c, t, g, unknown or other
  misc_feature (306)..(316): n is a, c, g, or t
tcagcgagagataccacgaccggtgctcgatttagcagacgtctgtggatcgccgcggacacggctgtttattactgtgcgagaagcctgggatattgtactagtaccagttgcctcagatacggcatggacgtctggggccaagggaccgcggtcaccgtctcctcagcctccaccaagggcccatcggtcttccccctggcaccctcctccaagagccacctctgggggcacagcggccctgggctgcctggtcaaggactacttccgtaatctctcgctgagcgggctggcaaggcgcatagnnnnnnnnnnn

SEQ ID NO: 148976 - DNA, 180 bp, Homo sapiens
  misc_feature: GYAE6OF01E3DUY.11.56.F01.1.454.CMB.1.raw
  modified_base (179)..(180): a, c, t, g, unknown or other
  misc_feature (179)..(180): n is a, c, g, or t
tcagcgagagataccacgaccggtgctcgatttagcagacgtctgaacaccaaagggcccatcggtcttccccctggcgccctgctccaggagcacctccgagagcacagcggccctgggctgcctggtcaaggactacttccgtatctctcgctgagcgggctggcaaggcgcatagnn

SEQ ID NO: 148977 - DNA, 833 bp, Homo sapiens
  misc_feature: GYAE6OF01DRR28.40.18.B07.1.454.CMB.1.raw
tcagtctagcgactcacgaccggtgctcgatttagtcgctgcgtaaggtaggtaagggggaggaactgctcagttaggacccagacggaaccatggaagccccagcgcagcttctcttcctcctgctactctggctcccagatacgcgctaggtagaaattagtgatgacgcagtcctccagcctaccgtcgtcgtagtgtcctaccgaagggaaacgtcgccacccgttcctaccgtcgacgacggacctaaggtacgtaacgtagtcgtttacgacctaaccgttacgttaacgccgttagggtaacccaaacgaccgtaaccggaacccgttcgggacccgaacgggtcccttaccccgtaacgggtccctttaccccggttacctaacgtttcccgttccggtttaccggggttaccgacccgtaaccggttaccccccggaaaccccgggggtccctaacccgttacgggttaccctaccccgtaggtccgtaagggtttccgtaacggtcgggtacgtacggggttcgggttaccggtagggaaccgtacggtacgttaccgtaccgttccgtaccaccgttactacgaacgtccgaacgtcccgtacgtacgtaacggttcgttaacggtaaacggttacgtttcggttacgttacgttaacgttttaccgttaccgttacgtacgtaccgtacgtacgttacgtaacgttcgtacgttacggtaccgtaacgttacggtttacggaccggtaagggaccctaaggtcgttacggagtacgtacgaaacgttcgtacggtcgactacggtcctaccgtcgttaccg

SEQ ID NO: 148978 - DNA, 741 bp, Homo sapiens
  misc_feature: GYAE6OF01EXJLT.40.18.B07.1.454.CMB.1.raw
  modified_base (213)..(213): a, c, t, g, unknown or other
  misc_feature (213)..(213): n is a, c, g, or t
  modified_base (337)..(337): a, c, t, g, unknown or other
  misc_feature (337)..(337): n is a, c, g, or t
  modified_base (729)..(729): a, c, t, g, unknown or other
  misc_feature (729)..(729): n is a, c, g, or t
tcagtctagcgactcacgaccggtgctcgatttagtcgctgcgtaaaggaggtaagggggagaactgctcagttaggacccagacggaaccatggaagccccagcgcagccttctcttcctcctgctactctggcctcccagtatagcgtctggaagaaatagttgatgacgcagtctccagccaccctgtctgtctactacggaaggaaacncgaccctacctctcgtgacgacggactagtagagtaggttcgtacgacctacgttaacgtacgtaccgtacgtaaccaacgaccgacggacctcgggaccacgccgttaccgacgtcctccgtntacgtccgtacgtcggtaccaccgtaccggtcccgacccgggtactacgttacggtaccacccgagtacggtacgtagtacggtcgtacggtagtcgggtacgtaacgggtactacggttacttacccaccgtttacgacctaaccgtagtaccgacgtaccgtacgtccggtacgtacggtaacggtaccgtaaggtacggttactagggtttacctagttttaccgttacgttaccggtagtaccgtacgtaacgtaggtaaccgtaccggtcgttacccggtaccgttaccgttaccgttacgggtaccgacggtaaccggttcgaaacgtcgtaaggaacgttacgtaaacgaacggttcgtacgtacgttaccgtaccgttaacctnttacggttaacc

SEQ ID NO: 148979 - DNA, 766 bp, Homo sapiens
  misc_feature: GYAE6OF01AIIZ2.40.18.B07.1.454.CMB.1.raw
tcagtctagcgactcacgaccggtgctcgatttagtcgctgcgtaaggtaggtaagggggaggaactgctcagttaggacccagacggaaccatggaagccccagcgcagcttctcttcctcctgctactctggctcccagatacgcgctaggagaattgtgatgacgcagtcctacccgtagcccttaccctcgtcgtagtcgtcctaccctaggaaaacgtgccctacccgtcctaccgtcgacgacggtcctaggtacgtagtacgtcgttcgaaacctaaccttacgttaacgcccgttgggtaaccctaacgaccgtaccgaaccgttcggacccgacggtcctaccccacggttcctccgttacctacgtccgtacgttcggtacgccgaccgttcccgacccggtccgacgttcggtaccctaccggtacgttacggtacggtttaccgacggtcggtacgtcgggttacgggtaccggttaacgggaaccgttaacgttaccgggttacctaccgttacccgttaccaacccgttacgtccgaaccggtcccgtaacggcccgtacgtacgtaacgttcgtaacggtacgtttactcggttgacgttacgttacgtcgtacgtcgacgtactacgtactacgttcgaccgttacggacgttaacgtacgttacgaaccggtacggaccgacgtcgtaacgtagaccgtacgtaaaccgttcgtacggtacgttacctacgcccttaaccgtcttaccg

SEQ ID NO: 148980 - DNA, 634 bp, Homo sapiens
  misc_feature: GYAE6OF01AJ633.40.18.B07.1.454.CMB.1.raw
  modified_base (206)..(206): a, c, t, g, unknown or other
  misc_feature (206)..(206): n is a, c, g, or t
tcagtctagcgactcacgaccggtgctcgatttagtcgctgcgtaaaggaggaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagngccaccctctcctgcgacgggccagtgagagtgttgacacctactagcctggtaccacacagacctggcccaggcctacccgaggtcctccctcgacttcctcttggtcgcacgtccccgaccccgggccacgtggtacctcccgagtccacggttcaggttcggacgtaggttcgggtctagggactaggtacgttccacttccgtccacccgtagtaccgagaccacgcccgtcgcgtacgtctaggtaacgtattggttcgtacgttacgttttacgttcccgttgtacgtagactacgtaaccaagtcgtaacgtcgggtaacccgtaccgttaccgtttacggacccggtaaggggtaaccctaggccgtaggagtaacgtacgaaaccgtacgtcggttcggactagtacccacgtcgttcg

SEQ ID NO: 148981 - DNA, 769 bp, Homo sapiens
  misc_feature: GYAE6OF01AHANW.40.18.B07.1.454.CMB.1.raw
  modified_base (188)..(188): a, c, t, g, unknown or other
  misc_feature (188)..(188): n is a, c, g, or t
  modified_base (356)..(356): a, c, t, g, unknown or other
  misc_feature (356)..(356): n is a, c, g, or t
tcagtctagcgactcacgaccggtgctcgatttagtcgctgcgtaaagggaggaaagggggaggaactgctcagttaggacccagacggaaccatggaagccccagcgcagcttctcttcctcctgctactctggcctcccagatagcgctggagaaatgtgatgacgcagtctccacgcccaccctntctgttgtctccgaaggggaaaatcgacccacccgttctccgtgccgaggggccaggtgaggtagttgttcgaacctaccttacgtagccgtacggtaaccaacacgacgaccgtcggacccgcggccctcccgacggtccttcccctacgattccgtcgtgggtccncctaaccgtccccggacccggcctacttaccgggtacctccccgtagtacgtacggttacgtacggttgggccgttagggtttcgggtaccgggttacgggtactacgggtaccgtttcctaaccgtttccctacgaccctaagttacccgacgaccgtacccggtccttacggaccttacggttaccggtaagtaaccgttggtttaacgttcgggtaaccttttaatttttacgtccccgttaggtacaacgtaggttaacctaacgtagtaccggtacgttccggtacccttggttaccggttccgggaaccgtaccggggtaactaacgggtcgaacgggtaagtaaccggtaaaccgaaacgggtttcgtcgggtaccggtacttccgaaccttacgtcgtttacccg

SEQ ID NO: 148982 - DNA, 751 bp, Homo sapiens
  misc_feature: GYAE6OF01C37Z7.40.18.B07.1.454.CMB.1.raw
  modified_base (131)..(131): a, c, t, g, unknown or other
  misc_feature (131)..(131): n is a, c, g, or t
  modified_base (146)..(146): a, c, t, g, unknown or other
  misc_feature (146)..(146): n is a, c, g, or t
  modified_base (183)..(183): a, c, t, g, unknown or other
  misc_feature (183)..(183): n is a, c, g, or t
  modified_base (597)..(597): a, c, t, g, unknown or other
  misc_feature (597)..(597): n is a, c, g, or t
  modified_base (650)..(650): a, c, t, g, unknown or other
  misc_feature (650)..(650): n is a, c, g, or t
tcagtctagcgactcacgaccggtgctcgatttagtcgctgcgtaaaggaggaaagggggaggaactgctcagttaggacccagacggaacatggaacgccccagcgcagcttctcttctcctgctactcnggcctccagatgcgngtaggaagtaaaatggtagatggacgtcctacgtccnccgacgccctaccgttgtcctggtcgtcgtaccggaaagggaaacgccgccctacctcgtcgaggcgacggcgagtgaggtgtgtacgactaccgtagtcgccgtaacgaaccactacgacgcgtacggccacgccgtccgacgtcctccgtctacgttcgtcgtggtccaccgtaccgtcccgggacccgtacgttccgtacggttacctacccgtggttaccggaggttcggaagtcggtcggtagggggttacggtcgtaacgggtacgtaggtaccttaaccgtaccgttcaccctaagacgtccgaacggacccttcgggccttcgaccggtaaatttggaaacggttagtttcgtgttacggttacttaacggtttcttagttacgtacgtactaacgttaaacggtntacccgtaaggttaccggtacgtttacccgtttacggttacggttaaccgggnggtaacccgggtaagtacggacgggtaaacggaaccgtttaaacggaccggtaagttacgggttcgggactaccgggtaacctacttaccgttcggttccc

SEQ ID NO: 148983 - DNA, 618 bp, Homo sapiens
  misc_feature: GYAE6OF02IIMCB.40.18.B07.1.454.CMB.1.raw
  modified_base (349)..(349): a, c, t, g, unknown or other
  misc_feature (349)..(349): n is a, c, g, or t
tcagtctagcgactcacgaccggtgctcgatttagtcgctgcgtaaaggaggaaagggggaggaactgctcagttaggacccagacggaaccatggaagccccagcgcagcttctcttcctcctgctactctggctcccagatagcgctggagaaatagtgatgacgcagtctccagccaccctgtctgtgtctccaagggaaaagagcccaccctctcctgcgagggccagtgagagtgttgacacctacttagcctgtaaccaacacagacctggccaggcctccaggctcctcatctctggtcgcactcccgacccggcctacgtcggtacctccagtcacggttnaggtcggcgtaggtcggtctgggactaggacgttcacctctacaccactacacgcagccgtgcgtagtcgtagtaagtagtagttgtacgttagtttactttaccgttcgtacgacgtacgtaagttaacgtaagtcgtaacgttcggtacccgttacgttacgttttacgggaccggtaaccggggaccgtaacggtacgtagggtaacgtacgtaaccgaaacgtaacgtacggtacgtaccgtacggaacctacccgtagttaccg

SEQ ID NO: 148984 - DNA, 538 bp, Homo sapiens
  misc_feature: GYAE6OF01A9WP3.21.20.B09.1.454.CMB.1.raw
  modified_base (530)..(530): a, c, t, g, unknown or other
  misc_feature (530)..(530): n is a, c, g, or t
tcagtcgtcgctcgcacgaccggtgctcgatttagtgtagtgtgaagtgaaagggtctccgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgcctattacggtatggacgtctggggccaagggccgcagtcaccgtctcctcacgcctccaccaacggcccatccggtccttccccctggccgccctcgcctccacggacgcacctccgacgagcacacgcggccctgggctcgcctggtcgaacggactaccttccctcgtctctactcgaggcggngtggacgg

SEQ ID NO: 148985 - DNA, 880 bp, Homo sapiens
  misc_feature: GYAE6OF01CDARE.21.20.B09.1.454.CMB.1.raw
tcagtcgtcgctcgcacgaccggtgctcgatttagtgtagtgtgagggaaagggtctccgaagccttcggacgaccctgtccctcacctgcactgtctctggtgctccatcatcaatggtcattatcacgtggggctggactccgccacgcccccgaggggaaggggctagggaggtcgggttcgacgtagttactttttcatcgactcgggaccaccttactatacggtcgtcgctacaacacgtcgagtccaccaatactccgtagacacgtaccaggaaccagtttcctccctagaacgtctacgaaccttcctacgtacgaccccggccgaccgaacgggtaccggtaccggggtaatttaagtttaagtttacgtttagggtacggacgggtaaacgtaccgttaaaggtttacgggtttacgggtttaagtttcgggaccctttaaccggtacccggttacccccgtttaagtttaacccggggttagttcgggtaccggtttcgggaccgggggaacccggtaaacggggcccctagacccggttacccgtaacccggtttcccttacccgtccgtaaccgtccccgtaaccccgaaacccgggaacccggggtacccctaaccggttccccggtttcccccttccccccggtacgggtccccctacccgtcgtccctaccgggacgtaccgaccctacccggaccggtaagacccgacgtaacggacccggtcccggtacccggtgggtacccctcggtaccgttacgggtaaccgaacgggttaccccttacccgggtacccgaccgggtaaccggaccggtaaacgtccgggaccgggtaccgggttacggaccggtacgggaaaccggg

SEQ ID NO: 148986 - DNA, 848 bp, Homo sapiens
  misc_feature: GYAE6OF02GS1VJ.21.20.B09.1.454.CMB.1.raw
tcagtcgtcgctcgcacgaccggtgctcgatttagtgtagtgtgaaagggaaagggtacgtcccgaaaacgccttcccggacgaccccgtgtaccctccacctgcactgtctcctggtcggctccgatcgactcgaatggtctactttatcgacgtggggctggatcccgaccaggccccccgacgggaacggggtccctagggacgtggggttcgcggtaggtactttttcgattggatcgggaccaccgtactaagtaggtccgtcggccttcgaacgtaggtcggacgtccaccgatacgtccgttacgacgtaccgttccgaacggtaaccaggtttcctaccccgttggtaaacgtcgtacggtaaaccgttcgtccgtacggaccccggccccggacaagggacccggtcgggggtaatagttaagttagttgtggacgtagacagtacgtaggtattggactactcgaccctaattacggtatcggacgtcgtacgggggccgaagggaccgcgtacgtccaccgtcctccgtcacgccctaccgaccgaacgggcccaagttcccgggtccccttccccgtggggtacccgcccgttcgtccgtacccggtagggaccgcccgaacccgttccggaacggtaccggaccccgaaccggtccgggtcccgggtacccccgttggggtcccgttacgggccccggtttaggggtacccgaaacggggttaaccccgtttaaacccggtttacccccgggaacggtacccgggtaaccggtaacccggttccgggggaacgggccccgggggtacgggttaccgggaaccggtaacccggggg

SEQ ID NO: 148987 - DNA, 562 bp, Homo sapiens
  misc_feature: GYAE6OF01CXYBQ.27.14.B03.1.454.CMB.1.raw
tcagagcgtcgtctcacgaccggtgctcgatttagtgtgagtagtttgtgtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctaccaaagctcctcatcaagtatgccttcccagtccttctcacggggtcccctgaggttcagtgcagtggatcgtgggacacatttccaccctcaccatcaatacgcctaggaagctagaagatgctgcaacttattactgtcatcagtagttacttactttacctactaagtcgacttcctaacccgttcggaaccctaaaggggaccaacggtacgtagggaacgtaactttaaaacggaacttggtagggccttacggaccctaacctaacttccgttggttaccc

SEQ ID NO: 148988 - DNA, 910 bp, Homo sapiens
  misc_feature: GYAE6OF01B4SFW.27.14.B03.1.454.CMB.1.raw
tcagagcgtcgtctcacgaccggtgctcgatttagtgtgagtagtttgggtttcggggaggtgagacaaaactggacaaggtcaaggggcaggagaatgttggcctatcacaacctcgtatttgggtttcttgctggtctctgggttccgagtcctcctaggggtgaacttggtggctgtactcagtctccagtactttcagtctcgtgactcgaaggacgtaagtcgaccatcgacctcgccggccagtcagagtcgtaggtacgtagtctttacgtactacggtacctacgactaaggaacgacgaggttactagtccttaccgtaacgcctacctacgaactacggaagtactcgtccgtttaaccctacgttccctttacttaccggtaccggggtcccctacggtaccggttaccggaacggttcggtaccgtacggtacgggaccttacggttcggggtaactaccgtaacggttttcccgtaacccgtacggaaccctagtttaccttaaacgttaccgtacccgttaacgggaacgttcctaacggtaaaccggtagtaccggtaccgttacggtaacctaaaccgtttattaaccgggttcgttaaccgtaacgttttacgtaaacgtttacggtttaaaccctttaacgtttttaacccttaagttaaacggtttcccgttaaaccgtttccccggttaacccgggtttaccccgggggtacccgggtaaaaccggggggtaaccccgtaaaccgggttaaaccgggttaaaggggtaaaccgtttaaaaaccggtttaaaacccggtaccggggtttcgggttaccgggaccgtttaaaccggtaaccccttaacgttacccggttttaccggtttcgtttaaccccgttttaaccccg

SEQ ID NO: 148989 - DNA, 643 bp, Homo sapiens
  misc_feature: GYAE6OF01D8JWL.27.14.B03.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
tcagagcgtcgtctcacgaccggtgctcgatttagtgtgagtagttagggttaggggatgagtacaaaactgacaaggtcaaagggacaaggtaagatgttgccatcacaactcattgggtttctgctgctctgggttccagcctccaggggtgaaattgtgctgactcagtctccagactttcagtctgtgactcaaagganaaagtcaccatcactgccgggcagtcagagcgttggtagtagtcttacactggtaccagcagaagccaggtcagtctccaaagctcctnatcaagtntgccttccagtccttctcgcgggtcccctgacgttcagtggcaggtgactcgtgggactactacgtttccacccgtcaacctatacaaatacgccgtaggaacgtcgtagaagtattcggtactcggtaactaaacctttacgtttacgtacgtactacgtaccgtaagttaacgttaaccgtttacgtttaaccctacgtaacgttcgtaacttaccgtaacccgttaccggacccggtaacgggtaaccacggtaccgtaagggtaacgtaaacgttaaacgaaccgttcgggacgttacgtacggtacctaaccgtactttccgtcgttccgtttaaccg

SEQ ID NO: 148990 - DNA, 718 bp, Homo sapiens
  misc_feature: GYAE6OF01BZOUL.27.14.B03.1.454.CMB.1.raw
  modified_base (260)..(260): a, c, t, g, unknown or other
  misc_feature (260)..(260): n is a, c, g, or t
tcagagcgtcgtctcacgaccggtgctcgatttagtgtgagtagtttcgggttgggggatgagacaaaacgtgacgaagtcgaaggcaggaagatgttgccatcaccaactcattgggtttctgctgctctgggttccagcctccgaggggtcgaaagttgtgtctgactcacgtctccagtactttcacgtctgtgactccaaaggagaaacgtcaccgatccacctgccggcagtcagagcgttaggtatagtctacnctcgaccagacagtaacgccaggtcacgtctaccaaagcctcctcatcgaagtctcgcctttcccagttccctttacgtccggtacggggttccccctacgggtacggttcgtacgggtcgacgtacggtggtactcggtagggacctacgtacgtttcccacccgtcacgtaacttaccaaattccggcctaggaactccgtagaacgtcgtcgacctagtaaccttaactttagttaactggtactaagttaccgtaaacgtttacgtttaacctttaacctttaccgaacgttaagttacgtaacttacccgttaacccgtttcccggaaccggtaaacgggacccgttaaccggtaacggttaacggggaaacgttaaacgtttaaaacgggtacgttacgggtacggtaacccgttaggtaccgtaaccctagttccgttcgttacccttacg

SEQ ID NO: 148991 - DNA, 572 bp, Homo sapiens
  misc_feature: GYAE6OF01CCYJO.27.14.B03.1.454.CMB.1.raw
tcagagcgtcgtctcacgaccggtgctcgatttagtgtgagtagttcgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacgggtcccctgaggttcagtgcagtggatcgtggacactatttccaccctcaccatcaatagcctaggaagctagaagatgctgactaactttatactgtacatcaagtagttaacttactttaacctacgtaagtcgtacttcctaccgttaccgggacccgtaacgggaccaaccggtacgtagggtaacgtaaacgtttaaaaccgaacgttggtacggtactcggacctaccctattccgttgttccgtttacc

SEQ ID NO: 148992 - DNA, 752 bp, Homo sapiens
  misc_feature: GYAE6OF01C15D7.27.14.B03.1.454.CMB.1.raw
tcagagcgtcgtctcacgaccggtgctcgatttagtgtgagtagtttgggtttcgggatgagcaaaactgacaagtcaaggcaggaagatgttgccatcacaactcattgggtttctgctgctctgggttccagcctccgaggggtgaaattgtgctgactcagtctccagtactttcagtctgtgactaccaaaggagaaagtcaccactcaccgtcgccgggccagtcagagtcggttaggtagtagcttacacgtcggtaccagcaagaacgccgaggtcacgtctaccaaacgctcctcatacaagttatcgccttcccagttccctttcgtccgtaccggggttcccctacggtacggttccgtaaggtcggcgtaggtaggacgttcggtacgggtaacctaaccgttacgtttcccaacccccttaccaaccctaacgtacctaaacgtacgtccggtaacggtaacgccgtaaggaacgacgttcgaccgttacggtaaccttaacttttaactttacgttcgttacctaacgttactaaacggtttaaccgttaacctttaaccgttttaacccgtacgttaaacgttacgtaaccttacccgttaacccggtttaccggaaccggtaaacggggaaccctaaccggtaacggttacgggaacgttaaacgtaaaaccgggtacgttacgggtacggttaccgtacgacccgttacctaacgttcttcgttcctttaaccccg

SEQ ID NO: 148993 - DNA, 723 bp, Homo sapiens
  misc_feature: GYAE6OF01DULHA.27.14.B03.1.454.CMB.1.raw
  modified_base (572)..(572): a, c, t, g, unknown or other
  misc_feature (572)..(572): n is a, c, g, or t
  modified_base (603)..(603): a, c, t, g, unknown or other
  misc_feature (603)..(603): n is a, c, g, or t
  modified_base (703)..(703): a, c, t, g, unknown or other
  misc_feature (703)..(703): n is a, c, g, or t
tcagagcgtcgtctcacgaccggtgctcgatttagtgtgagtagtttgggttagggggaatcgagacaaaaactacgacaagtcgaaggcaggaagatgttcgcctatcacaactctacttgggttctgcctgcttcgtgggttccacgtcctcccgtaggggtactaactttggtcgtcttggacttcgaggttccttccgaagtaccttttccagttcttggtaggtacctaccgaaaagggtacgaaacgtctaccgtatccaacccgtcgggcccgggggacaagtccgaagtcgtcggttagtagtagtcttacgacgtggtaccagcctaagaacgcctaggtctacgtcctaaccaagccttaccactagtacctaaggtactcggtcccttcccgacgtttccctcgtcccggtaccgggttccccctaggttaagtttccgagtcggtaccgtaagtcggaacgttcgttcgggtacctaccggttaccttccaacccgtctacctatactacgtacgccgtaggtacagtacgagtctcgtcctacactacgttagtacgtntacgtatactagtacttacttaccttacgtntaagttctacttacgtacgtccggtacgtaaaggtccgtagtgtaggtaacgttaacgttaaacggttcgtcggtaccgtgtaaccgtcctaaacccgtnttaccggtcctttaccgtcg

SEQ ID NO: 148994 - DNA, 788 bp, Homo sapiens
  misc_feature: GYAE6OF01BEAXC.27.14.B03.1.454.CMB.1.raw
  modified_base (230)..(230): a, c, t, g, unknown or other
  misc_feature (230)..(230): n is a, c, g, or t
tcagagcgtcgtctcacgaccggtgctcgatttagtgtgagtagtttgggtttcgggatcttaaaagaggttctttctctgggatgtggcagtgagacaaaactgacaagtcaaggcaggaagatgttgccatcacaactcattgggtttctgctgctctgggttccagcctcaggggtgaaattgtgctgactcagtctccagactttcagtctgtgactccaaagganaagtcaccatcacctgccggccagtcagagcggttgtagtagcttacacgtggtaccagacagaaagccgaggtcagtcctaccaaacggtcctcctacacttacaacgttaacgtgtcccttacccgacgtttcccgttactaccgtaccgggggttccccctacggtacgggttacgtacggttcgggaccgtagggttacggtacgttaccggtacggggtaacctaacccttaaccgttttacccgaaccccccgtttaaccaacccctaacgttaaccgtaaaacgttaacccggtacccgttaacggggtaaaccggtaccgtacgggtaaacggtacgttacgtaaccgttacggaaccttaaaccttttacgtttaaccgttacgttacctaacgtaccggtaagttaccgttaaccctttaaaccggtttaccccttaacgtaaaccggttcgtaaccttaccggtaccccgttaaccggtacccggtaaaccggttaccgaacccggtaaaccgtaggggtaaacccgttaaaggttaaaaacccggg

SEQ ID NO: 148995 - DNA, 803 bp, Homo sapiens
  misc_feature: GYAE6OF01C7F1S.27.14.B03.1.454.CMB.1.raw
  modified_base (785)..(785): a, c, t, g, unknown or other
  misc_feature (785)..(785): n is a, c, g, or t
tcagagcgtcgtctcacgaccggtgctcgatttagtgtgagtagttcgggtttggggatgagcaaaactgacaagtcaaggcaggaagatgttgccatcacaactcattgggtttctgctgctctgggttccagcctccgagggtgaaattgtgctgactcagtctccagtactttcagtctgtgactaccgaaaggagaaagtcaccatcacctgccggccagtcgagagtcgttggtagtacgtcttacgactggtaccagcaagaacgccaggtcacgtcctacaacgctcctacatacgaagtatcgtccttcccgtacgttcccttcgtccgtaccgggttccccgtacggtacggttaccgtacggtcggacgtaggtcggtacgttacgtacgggtaacctaacgttaccttttacccgtaacccccttaccgtaaaccctacgttaacctaaacggtaccggttaccgtaacggggtaaacctacggttaacgtaaaacggtcttacgggtaccttaacggttaaacctttaaaccgttttaactttaaccgttacgttaccgtaactttacgtaaacgttaccgtttaaacctttaccgtttaacccgtaacgttaaacgttcgtacttacccgttaaccgtttacccgggaacccgtaaggggtaaccgtaccggtaaaccgggttaggaaaccggttaaaacggtttaaaaccggtaggttacggttacccggggtacttacccgggaaccctaacccgttagtttacccgttntttacccgtttaaccccg

SEQ ID NO: 148996 - DNA, 899 bp, Homo sapiens
  misc_feature: GYAE6OF01CL2HF.27.14.B03.1.454.CMB.1.raw
tcagagcgtcgtctcacgaccggtgctcgatttagtgtgagtagttcgggtttggggatgagacaaaactgacaagtcaaggcaggaagatgttgccatcaacaactcagtttgggtttctgctgcttcgtcgggttccacgtccgtcggagggtataagttgtgcttgacctacgtacgtcctccgtaagttctttcgagttcgttaggtacgaaccgtaacggaaaaggtacgtaactcccaaccgtactaccgaccgtaccggacccgggtacgtagtaccgtaaggttacggttacgggtttaagggttaacgtaacggttaaccgttttaacgaaccggttaccggtaacgaacggaacgtaacggaaccggtaccggtaacggtaccttaaccgtaccctaaaccggtaaacctcccgttacctaacgaccgttaagtacgttacgttcgtacccgttaccgttaccctttacgtttacccgtcccgggttaacccgggttccccgttaacgggttaccggttaccggtggttaacggtcggtaacggtttacggtaccgtacggttaaccgttaaccgttaccgttaaccttacccctaaccccgttaactaacccggttaataacgtaacgttaccggtaaccgtaggtaaccgtagtaacgtaacgtcgtacggtttacaacgttaacttaacgtttagtacctatacccgtagttaacgtacttaagtttaccgttaacgttactaacggttacgtacgttaaccgttaccgttaaacccggttacgaacccgggtaagttaccgacgtaacgttaaggtaaaaccgtaaacgttacgtaccgttcgtacggaacgtacctccttaagtcctacgttccttagtccccg

SEQ ID NO: 148997 - DNA, 757 bp, Homo sapiens
  misc_feature: GYAE6OF01EDAHK.27.14.B03.1.454.CMB.1.raw
  modified_base (147)..(147): a, c, t, g, unknown or other
  misc_feature (147)..(147): n is a, c, g, or t
  modified_base (397)..(397): a, c, t, g, unknown or other
  misc_feature (397)..(397): n is a, c, g, or t
tcagagcgtcgtctcacgaccggtgctcgatttagtgtgagtagttcgggtttggggatgagcaaaactgacaagtcaaggcgaggaagatgttgccatcacaactcattgggtttctgctgctctggttccagcctccgaggggtnaattgtgctgactcgagtcctccgagtactttcacgttctggtacgactaccgaaaggagaaacgtcaacctataccaccgtcggccgggtaccaagtacgagacgtcggttggtacgtagtacctttaacacgtacgtaccgagcaagaacgccgtagtactagtctaccaagtcctacctacatacgaagttactctaccgttacccattccgtacgtccgtaccgggttcccctaggtacgttacgnggtcggacgtagcgtactcggtacggactctacttacaccctacacctataccgtatacgtacgtaggaactacgtagaagtacgttcgtaactacggtaaacctttaaccgttacgtttaccgttaactaacgtacgttactaacgttagttttaaccccgtttaatttaaccccgtagtaaccgttacggtaacctttaccccgtaaaccgttccgggaaacccggttaaacgggtaccctaacgggttaaaccgttaagggtaaaaccgttaaacccggttaaaaggttacttaacggggtttacgacccgttaccgtaaccgacttaccctttaggtttcccctagtttaaccccc

SEQ ID NO: 148998 - DNA, 701 bp, Homo sapiens
  misc_feature: GYAE6OF01AYUNY.27.14.B03.1.454.CMB.1.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
tcagagcgtcgtctcacgaccggtgctcgatttagtgtgagtagttcgggtttgggatgagcaaaactgacaagtcaaggcaggaagatgttgccatcacaactcattgggtttctgctgctctgggttccagcctccgagggtgaaattgtgctgactcagtctccagtactttcagtctgtgactcaaagganaaacgtccacatcacctcgccgggcagtcagagtcgttggtagtacgtcttacacgtgtaccancgaagaacgccaggtcagtcctcaaagctcctcgactacaaacgttntcgtaccttccctacgtttcccttcgtaccgtaaccggggttcccctacggttaacgtttccgtacggttacggccgtaggtcggacgttacggacggacctaacgttactttacccgtaccctacaacccttataccgtaaactacgaccgtaggaacgtaccgtaggaagtaccgtagtctaacgtaacttaacttagttaccgtgtacgtacgtacacgttacttaacccgtttacgtttaacctaacgttacggtacgtaccttaccgtacccgttaccggtaacccaacgggttaactaccgaacggttaaaggtaacgtaaaaccgttaaacggaacttacggacgttccgttacgtacccgtactaccgtacttcggttacttacccg

SEQ ID NO: 148999 - DNA, 377 bp, Homo sapiens
  misc_feature: GYAE6OF01ENNQE.27.14.B03.1.454.CMB.1.raw
  modified_base (142)..(142): a, c, t, g, unknown or other
  misc_feature (142)..(142): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
  modified_base (301)..(377): a, c, t, g, unknown or other
  misc_feature (301)..(377): n is a, c, g, or t
tcagagcgtcgtctcacgaccggtgctcgatttagtgtgagtagtttgggtctgggacacatttcaccctcaccatcaatagcctggaagctgaaagatgctgcaacttattactgtcatccaagacgttactactttaccncgaagtgatcgtaccttcggaccaagggactacgactgaagtaattaaacgactggtgctgcacctatcgtactcttcattcccttcccgcacgtctagaacgacgccgtntccgtaggaggccggggtcncgggaccaaggggctacaaatggangtnnnnnnnnnnnnnnnnnnnnnnnnnnnnnnnnnnnnnnnnnnnnnnnnnnnnnnnnnnnnnnnnnnnnnnnnnnnnn

SEQ ID NO: 149000 - DNA, 718 bp, Homo sapiens
  misc_feature: GYAE6OF02F2FD6.27.14.B03.1.454.CMB.1.raw
tcagagcgtcgtctcacgaccggtgctcgatttagtgtgagtagttaggggttccggggcgatgagcaaactgacaagtccaaggcgaggaaggactggttggtcccattcacgaacgtcaattgggtttcctagcgtgcctactcgggttccgaggccctaccagggggtcaaagttgtggtccttgggaccttcgaaggttctaaaccgacgtacggttttccagtcgtggtacggacttcccaaagggacgaaaaggttccaaccccgagtccaaccttcggtcccgggaccagtcacgaagtcgtttaggtaggtagccttacacgtcggtaccgagacgagtagaccagggtcaggggtactccaaagtcccgtaccgtctagtaccaaagtaactcggccttacccaaggttacccgtttcctacggacggggttaccccctacggttacggtttactaacggttgggccgaggtcgactaccgtacgggacgacctagtttcgacccgtcaccgagtccaatagtcctgggaacgctacggacgtactgtactggtacaacttagtacgtgtcgtagtacgagtagtaccgttacgttaccgttacgtagtgacttcgtaccgtttacggaccgacgggaccgacgacgtcggaacggtacttaaaccgtacgtcgtcggacctagaccgacccacgttccgtcgttcccg

SEQ ID NO: 149001 - DNA, 616 bp, Homo sapiens
  misc_feature: GYAE6OF02HK4MM.27.14.B03.1.454.CMB.1.raw
  modified_base (196)..(196): a, c, t, g, unknown or other
  misc_feature (196)..(196): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagagcgtcgtctcacgaccggtgctcgatttagtgtgagtagttcgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaagganaaagtcaccatcacctgccgggccagtcagagcgttggtagtagcttacactggtaccagcagaagccaggtcagtctccaaagcctcctcatcaagtatgccttcccagtccttctcacggggtcccctcgaggttcaggtggcaggtgatcgtggacactatttccaccctcaccatcaatgcctggaanctagaagntgctgactaattatactgtcatacagtagtaccttactttaacctacgtaagttcgaattcccgtaaccgtttaccgggacccgtaaacggggaaccctaacggtaccgttaggggaaccgttaaacggtttaaaaccgggtaaccgtttacgggttacgggtacccttacgggtaacccgtaaccccttaagttaccccgtttgttaccctttaacccg

SEQ ID NO: 149002 - DNA, 501 bp, Homo sapiens
  misc_feature: GYAE6OF02I8YKC.27.14.B03.1.454.CMB.1.raw
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagagcgtcgtctcacgaccggtgctcgatttagtgtgagtagttcgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtcctctcagggtcccctgagttcagtggcagtggatctgggacacatttcaccctcaccatcaatagcctggaagctagaagngtgctgctaacttattactgtcatcagtatacttactttactactagtnatctaccttcggaccaaggaccacgactggagtaataacgactgtgctcgcaccntctntnttac

SEQ ID NO: 149003 - DNA, 602 bp, Homo sapiens
  misc_feature: GYAE6OF02FK7A4.27.14.B03.1.454.CMB.1.raw
  modified_base (199)..(199): a, c, t, g, unknown or other
  misc_feature (199)..(199): n is a, c, g, or t
  modified_base (467)..(467): a, c, t, g, unknown or other
  misc_feature (467)..(467): n is a, c, g, or t
tcagagcgtcgtctcacgaccggtgctcgatttagtgtgagtagtttgggtttagggggatgagcaaaactgacaagtcaaggcaggaagatgttgccatcacaactcattgggtttctgctgctctgggttccagcctccaggggtgaaattgtgcctggactcagtctccagactttcagtctgtgactccaaaggngaaagtcaccatcacctgccgggcagtcagagcgttggtagtagcttacactggtaccagtcagagccaggtcagtctccaaagctcctcatcgaagtatgtcttacccagtccttctcgacgggtcccctcggacggttccagtcggcacgtcggatcgtgggacacgtatttccaccctcaccatcaagtacgcctaggaacgctagaacgtactgactggactaacttattactcgtacatcaagtacgtacctactttaacccngtaacgtcgtaactccgtaaccgttccgggacctaaggggtacctaacggtacagggtaacgtaaacttaaaccggaaactcgggttacgacggttacgaccgtaacccgtacggttcctacggttacttacccg

SEQ ID NO: 149004 - DNA, 535 bp, Homo sapiens
  misc_feature: GYAE6OF02JIJIP.27.14.B03.1.454.CMB.1.raw
  modified_base (195)..(195): a, c, t, g, unknown or other
  misc_feature (195)..(195): n is a, c, g, or t
tcagagcgtcgtctcacgaccggtgctcgatttagtgtgagtagttcgggtttggggatgagcaaaactgacaagtcaaggcaggaagatgttgccatcacaactcattgggtttctgctgctctgggttccagcctccagggtgaaattgtgctgactcagtctccagactttcagtctgtgactccaaagganaaagtcaccatcacctgccggccagtcagagcgttggagtagcttacactggtaccagcagaagccaggtcagtctccaaagctcctcatcaagtatgcttccagtccttctcacgggtcccctgaggttcagtggcagtgatctgggacacacgtttcaccctcaaccatacaatacgctaggaagctcgaaagatggctcgactaacttattacgtgtacacttcaagtacgtaaccttactttacctataaagtcgtatcctaccttcggaccgaagggacacggtactggactaagttaaacggatggtacgctcgacctacatctagttcttacc

SEQ ID NO: 149005 - DNA, 795 bp, Homo sapiens
  misc_feature: GYAE6OF02H1D5Q.27.14.B03.1.454.CMB.1.raw
tcagagcgtcgtctcacgaccggtgctcgatttagtgtgagtagtttagggtttaggggggccaactgacgcaaaacgtgaacaacgtcaaggcaggaagatcgttgccatcgacaacgtcagttgggttctgcttgtcgtcgtgggttccagcctccgacggggtgaaacttgtcgcgttgactcaggtctccgagtactttcgagtctgtggactacgaaaggacgaaggtcacagtcaccgtcggccgggcacgtcgacgtacggtcggtttaggttacgttaacggctttaacgacggttacggtaccacggtcgaacggaacggccgtaacgggtccgaggtaccgtaacccgaaacggtccttacccgtacgacgttacggtaaggttacgtcgtcgttacccgtacgttaccgtttccgtacgggtaaccgggggttacccctagggtaacggtttcgaggttcggacgtaggttacggtacggtacgtacggactacgtacgtttaccaacccgtacaaaccgtataaccgtaacgtaccgtaccgtacggaaacgtaccgttaacggaacgtagtcgtacggtacgtaaccgttaacgtttaccgttaaccgttacggttactaacgttaccgaggtaaccgttaacccgtttaaccgttacgttactaagttcgacgttaccgtacgtccgaaacggtacggaccgtacggttaccggtagggtaacggaactttaacggacgttacggcggtacgtaccggaccttaggtacttccgttcgtcc

SEQ ID NO: 149006 - DNA, 843 bp, Homo sapiens
  misc_feature: GYAE6OF02F3MCX.27.14.B03.1.454.CMB.1.raw
  modified_base (148)..(148): a, c, t, g, unknown or other
  misc_feature (148)..(148): n is a, c, g, or t
tcagagcgtcgtctcacgaccggtgctcgatttagtgtgagtagtttaggggtttggggatgagcaaaacttgaccaagtcgaacggcaggaagactgttgccatctacaactcattggttctgctgctcctggtcagcctcagggtntaattgtgctgactcacgtctccacgtacttttctagttccttgtagggaactccgaaacggacgtaaaacgttccaccgattccgaccctaggcccgggaccaggttcctaacgacgtcggtttaggtacgttaggtaccttaaccgacgttaccggtaccgacgacgacgtaacgcccgacggtcaagttcttaccgaaagtcctacctactactactaacggtagtcgtaccttcccgacgtttccttccgtaccggaccggggttcccccttacggtacgggtttccgaacggttcgggtaccgtacggtagggtaaccttcggtacggggtaaccctacgttaactttttcccgaaccccttaccaacccgtactaccgtaaaacgtccgtaccggtacggtaaaccgtcgttaacggtaaacgtttacgttacggtaacgtttaacgtacccttaaacggttttaccttaaccggttacgttaaccgttaaccgttacgttaaccggttaccggtttaacccggtttaacccttttaacccgtttaccggtaacggtttaccgtaacttaaccgttacccgttacgggaaaccgtaaacggtaaccgtacgtacgtacgggtaacgtaacggtaaacccgtagttacggtcgtacgttacgacctacctcttaccgttcgttccttacg

SEQ ID NO: 149007 - DNA, 787 bp, Homo sapiens
  misc_feature: GYAE6OF02GJ7JQ.27.14.B03.1.454.CMB.1.raw
tcagagcgtcgtctcacgaccggtgctcgatttagtgtgagtagttgggttagggggatgagcaaaactgacaagtcaaggcaggaagatgttgccagtccacaactcattgggttctgctgctctgggttccagcctccaggggtcgaaattgtgctgactcagtctccacgactttcagtctcgtcgactccaaaagggacgaaaagtcaccaatcacctgccgggccagtcagagtcggttggtagtagtctaacgctggtaccagcagaagccaggtcagtctacaaagctaccgtacacgtacaacgtactcggaccttcccgagtccttcgtccgtaaccggggttcccctaggtacggttacagggttcgggacctaggtcggtaagttccggtacggggaactacgtaacgtttaccaaccccgttcgaaccgtaacttacgtaaactacggtaccccgtaagggtaaacgtcgtaacggaaacgggtacgtcgtacctacgggtaaccttaaaccgtttatttaaaccggtcgttaccgaacttacgtaaacggttagtttaaacccctttacgtttaaccctaaccttaaagggttacctaactttacccgtaacccgtttacccgggaaacccggtaaaggggtaccctaaccggtaacggtaaccgggtaaacggttaaaacggttaaaacccggtaacgttacgggttaaccggtaccgttaaggtaccccggtaaacccgttacgttaccctttacgggtacccctttaaccg

SEQ ID NO: 149008 - DNA, 815 bp, Homo sapiens
  misc_feature: GYAE6OF02JNHDY.27.14.B03.1.454.CMB.1.raw
tcagagcgtcgtctcacgaccggtgctcgatttagtgtgagtagtttgggtttcgggagtcttaaagaggttctttctctggatgtggcatgagcgaaaactgactaagtcaaggcagaagatgttgccatcacaacgtcattgggtttctgcgtcgctcgtgggttaccagccttccgaagggtcaaagttcgtgctgacgtcgtagtcctccgagtacctttcgagtctgtcgactacgaaaggagaaacgtcaccattccgaccgtcggccggaccacggtacgacgagtccggttaggaacgttaggtacctttaacggacgttacggtaaccgagaccgtagaacggtccccgaaggttaccgtaacgtcccgtaaccaaaacggtccttacccgtacactaacgtaagttacgtcgtaccttacccgacgttccccgttacgtacccggtaccggggttcccctaggtaccggttacgtacgggtcgtacgtacggtcggtaacttccgggtacggtaaccctacgttaaccgtttcccgaaccccgtcccgtaaccgtagttaacccgtaagttaccggtacccgtaggaacgttaccgtggaaacgtacgttcgtaccgtttagtaacccggtttaaactttacgttaccgttacgttacgtacgtttaccgtaacgttaacggttacccgttttaacgtacccgttaacgtacggttacccttaccgttaaccgttcccgttaacccggtacccgtaacggaccgttaccggtaaccggtaggtaacgttaacccgttaaacccgg

SEQ ID NO: 149009 - DNA, 664 bp, Homo sapiens
  misc_feature: GYAE6OF02G92IL.27.14.B03.1.454.CMB.1.raw
  modified_base (299)..(299): a, c, t, g, unknown or other
  misc_feature (299)..(299): n is a, c, g, or t
tcagagcgtcgtctcacgaccggtgctcgatttagtgtgagtagttcgggtttggggatgagcaaaaactgacaagtcaaggcaggaagatgttgccatcacaactcattgggtttctgctgctctgggttccagcctccaggggtgaaattgtgctgactcagtctccagacttttcagtctgtgactccaaaggagaaagtcaccatcacctgccgggccagtccagagcgttggtagtagcttacactggtaccagcagaagccaggtcagtctacccaaagctcctcatcaagtntgtcctccagttccttctcgacgggtcccctgacgttcgagtggcagtggatcgtggacacgtactttcacccctcacctatacaactacgccgtaggaacgtcgtaagtaacgattcgcgtagtacctaaactttacttaacttacgtcaacttacaacggttacttaaccgtttaccttttaacctacgttaaacgttcgtaaacttcccgtaacccgttttacccgggacccgtaaaggggtaacccgtaaccggtaccgttacgggaaagttaaacggtttaaaacccggtaaccgtttggttacgggtaccgtttccgacgtaaccccgtattacccgtttacggtacccttttacccgg

SEQ ID NO: 149010 - DNA, 806 bp, Homo sapiens
  misc_feature: GYAE6OF02GJRSY.27.14.B03.1.454.CMB.1.raw
tcagagcgtcgtctcacgaccggtgctcgatttagtgtgagtagtttagggtttgggggatggagcaaaactgacaagtcaaggcaggaagatgttgccatcacaactcattgggtttctgctgctctgggttccagcctccaggggtgaattgtgctgactcagtctccagtacttacacgtctgtagacctaccgaaaggacgaagtccaccactaccgacctcgccggggcacgtcgacgtagtccggttaggtacgtacgtacgttaccgacgttacggtaaccaggacaaggaacgccgaaggttcaacggtccgtaccaaacggtccctaccgtacaacttacgaacgttacttcgtaccttcccgacgtttccttaccgtaccggtaccgggttcccccgtaggtacggttccgtaggtcggactggtcggacgttcggacggtactactacgttacctaccctacctaacgtacctacgtaacgtaccggtaccgtacgggaacgtacggtaacggaagtaccgtacggtacgttaaccggaaccttaaacgttttaaacctttacggttactcgtaaacgtaccgtaaacggtttaacttttaacccggtttaacctttaaacccgttagttaaacccgtttggtaaccccttacgtttaacccgggttacccaaaacgggtaacgggaaccctaaccggtaccgtaagggtaaccgttaaacggtaaaacctaggttacccggcgttaccgtacggccttaaacccggtctttccggtttacgtaccgtttaaccc

SEQ ID NO: 149011 - DNA, 719 bp, Homo sapiens
  misc_feature: GYAE6OF02IZMCF.27.14.B03.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (328)..(328): a, c, t, g, unknown or other
  misc_feature (328)..(328): n is a, c, g, or t
tcagagcgtcgtctcacgaccggtgctcgatttagtgtgagtagtttagggtttggggatgagcaaaactgacaagtcaaggcaggaagatgttgccatcacaactcattgggtttctgctgctctgggttccagcctccgaggggtnaaattgtgctgactcagtctccagtacctttcagtctgtgactacaaaggganaaagtcaaccatccgaccgtcgccggctagtcagtagcgttaggtaagtgtccttacacgtaggtaaccaggtccaagaacgccgaggtacagtccgtaaccaagtcctacctcaactacgaaagtntaccgccttcccaagttcccttacgaccgtccggggtcccctaggtacggtttccgaggtaggacctaggtcggaacgttcggtacgggacctaacgttctttacccgaacccgtactaacctaactactaaacgtaccgctaagggagtacccgttaggaaacggttactgtaccgtacgttaacgtaaaccgtttacttacgttacgttacctaagttccaaagttaacccttaactttaccgtttaacccacgtaactaacgtctaaccccgttcgacccggtaacgaacgggtaacaccggtacggtactaaacgggtaacttaaacggtagtcccggtaccgtacggtaaccgtaccttacgtaccttacttccggtaccttaccg

SEQ ID NO: 149012 - DNA, 562 bp, Homo sapiens
  misc_feature: GYAE6OF01DCZH4.10.63.F08.1.454.CMB.1.raw
  modified_base (379)..(379): a, c, t, g, unknown or other
  misc_feature (379)..(379): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaagagccaccctctcctgcagggccagtcagagtgtttcccgctacttagcctggtaccaacagaagcctggccaggcctcccgaggcctcctcatgtatgatgcatccaacgagggccacgtggcactccccagccaggttcagtggcaggtgggtctgcgacagacttcactctcaccatcaacncgcctaagaacctagaagtatttgactactttattctgtcacctagtacgtcgctaacgtcggcctccgacggttccggccgtacggggaccaagggtggagagtccgaagaccgtaacgtcggtcggctacggccacccgtattccgttcgttaccttacctacttcccgttccccggtacc

SEQ ID NO: 149013 - DNA, 495 bp, Homo sapiens
  misc_feature: GYAE6OF01E1SM1.10.63.F08.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (486)..(486): a, c, t, g, unknown or other
  misc_feature (486)..(486): n is a, c, g, or t
tcagcatagtagtgcacgaccggtgctcgatttagcgatcgtataagggggaggaactgctcagttaggacccagacggaaccatggaagccccagcgcagcttctcttcctcctgctactctggctcccagacaacactgcagaaatagttatgacgcagtctccagccaccctgtctgtgtctccagggganagagccaccctctcctgcagggccggtcagaatattgctaccaacttagcctggtatcaacaaagcctggccaggctcccagactcctcatctctggtncatcttcgagggccactggtcgtcccagccaggttcagtggcaggtggtcnggaacngagttcactctcaccatcagcgcctgcagtctagaagtatttgctagtttatactgtcagtctagtataatgtagttggtttatctacttcggcctggacctaagtgtattcgagtacgtatgtggctgcactatntgtctctcg

SEQ ID NO: 149014 - DNA, 592 bp, Homo sapiens
  misc_feature: GYAE6OF01C550P.10.63.F08.1.454.CMB.1.raw
  modified_base (194)..(194): a, c, t, g, unknown or other
  misc_feature (194)..(194): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctccagaaactaccgcagaaattgtgttgacacagtctccagccacctgtctttgtctcgaggggaaangccacctctcctgcagggccagtcagtgtcgtttccgntacttagtctggtaaccaanagaacctggccaggctccgaggctcctcatctatcgatgactactccaacggacgggcctaacgtggcactcccagcctaggttcaggtgctaggtgggtctggggacagtcttcactctcacatccgaccgtcctagccctagtaactattttgacttagtttattactgtactagctagcgtacgctacgtctcggtcccctcgttccctactccggtttaccgggcgggtaacgggtacctaaggggtcgaacgtacgtaacgaaacgtacgtaggtcggtacttcgacctaaccgtatccgtttacgttccttactaccttcccggtcccctaccg

SEQ ID NO: 149015 - DNA, 682 bp, Homo sapiens
  misc_feature: GYAE6OF01EVAHU.10.63.F08.1.454.CMB.1.raw
  modified_base (196)..(196): a, c, t, g, unknown or other
  misc_feature (196)..(196): n is a, c, g, or t
tcagcatagtagtgcacgaccggtgctcgatttagcgatcgtataagggggaggaactgctcagttaggacccagggggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtcgtttcccgcttacttagcctggtaaccaacagaacgcctggccaggcctcccgaggcctcctcatgtatgatgcatccaacgacgggccacgtggccactccccgagccctagggttcaggtggcaggtcggtctggcgacagtacttcacttctaccacctataccaaacacgtaccctaagaacccttagaacgtattttacgacttaacttttatttcctagttaccaaccgtagtacgtccgacctaacgtcgggtcccttacccggtaccggtttccgggacccggtaacggggggtaacccgtaaggggtacgggaacggtacgttaccgaaacggtaaccggtaaacgttcgggttacgggtccgttacggacccgtaacccgtacttcccgttacggtttaccttacccgttaaccgtttccccgtttccccccggaccttaaccg

SEQ ID NO: 149016 - DNA, 634 bp, Homo sapiens
  misc_feature: GYAE6OF01CPNT3.10.63.F08.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (386)..(386): a, c, t, g, unknown or other
  misc_feature (386)..(386): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaangccaccctctcctgcagggccagtcagagttcgtttccgcttacttagcctggtaccaanagaacgcctggccaggcctccgaggctcctcatgtatgatgcatccaacgagggccacgtggcatcccgagccaggttcagtggctaggtgggtctgcgacagtacttcactctacacctataccaacncgacctagaacctgtaagtattttgacttaacttttactttctacgttcctaacgtagtacgtccgactaacgtcggtcccgtacccggtaccggtttccgggacccggtacgggggaaccctaaggggttcggaggtacgtaccgaacggaaccggtaacgttgggtacgggtaccgttaggacccgtaacccgttacttccgttccggtttactttcccgtaactttccccgtttccccggtaccc

SEQ ID NO: 149017 - DNA, 619 bp, Homo sapiens
  misc_feature: GYAE6OF01CF1VU.10.63.F08.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtgtttcccgnttacttagcctggtaccaacagaacgcctggccaggcctcccgaggcctcctcatgtatgatgcactaccgaacgagggcccacgtcgggaccactccccaaggcctaaggttccaaggtggctaggtcgggtctggcgacagtaccttcactctacaccatacaacacgacctaacgaacctagaagttatttgacttactttatttcttcgtacaccgtagtacgtcgtactaacgtcgccgtaccggtacggttccggaccgggtacggggaaccgtaagggtacggacgacgtacgaacggacgtaacgtggtacggcgtacgcctaccgtacgtttaccgttacgttccgtttacctacttccccgttccccgtaccg

SEQ ID NO: 149018 - DNA, 575 bp, Homo sapiens
  misc_feature: GYAE6OF01EBPH2.10.63.F08.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtgttagcactaacttagtctggtaccaanagaaacctggccaggctcccaggctcctcatctatgatgcatccgacgacgggccacgtggccatcccagccaggttcagtggcaggtcgggtctgggacagacttcactctacacctatccgaccggtccttaacgaccctagaacgttatttgacttagtttactactgtacagtcagcgtagcagctcgccctcgtccctcgtacgtttccgggacggacgggaccgtaagggtcgaacgtacgtacgaaacgtacgtcggtacggcttcggacctacctagttccttacgttaccttctacgttcccgttaccccg

SEQ ID NO: 149019 - DNA, 665 bp, Homo sapiens
  misc_feature: GYAE6OF01BJMFG.10.63.F08.1.454.CMB.1.raw
  modified_base (197)..(197): a, c, t, g, unknown or other
  misc_feature (197)..(197): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaanacgccaccctctcctgcagggccagtcagagtgttcccgctacttagcctggtatacaaacaaaagcctaggccaggcctacccagactcctcatctcgtgtgctactcgttcgacggccacgtggtctcccagcctaggttcagtggacctaggtcgggtctacggaacacgtagttcacgttctacaccatcgaggccggctgaccgtagtacgtagaagttatttagacttaagttttacttattacgtactaaggtactaacgttaataacgttaggttaacgtttagggtttttaactttaccgttaccgttttacccgggacccggttacgggtaacccttaaagggttacggttaacgtttacgaacggtaacgtaacgttggtacggtcgtacgaccggtaacctacttaccgttacgttaccgttacctaaccgtttcccgttaccccggtcttaaccg

SEQ ID NO: 149020 - DNA, 754 bp, Homo sapiens
  misc_feature: GYAE6OF01C5C6J.10.63.F08.1.454.CMB.1.raw
  modified_base (480)..(480): a, c, t, g, unknown or other
  misc_feature (480)..(480): n is a, c, g, or t
tcagcatagtagtgcacgaccggtgctcgatttagcgatcgtataagggggaggaactgctcagttaggacccagagggaaccatggaagccccagctcagcttctcttcctcctgctactctggcctcccagatcgccaccggagctagttgtattgacacacgtcctcctacgccctacccttgttctttcgtcctaccggaaggggaaacgccgtcccaccctctccgtgcgacggcctagtcaggagtcgttagactaacttactcgccgttacgtaaccaacaacgaaccgtcggaccgacggccgtacccgacggtcctacctactactcttagtacgtaacgtcgtaactccggaaccgggcccggtcctacggtccggtacccgtacccgacgtacccggtaggttaccggaggtcggtacgtagggtttcgggacggtacggactacgtctaccgtacgtaccactactanccgagaccgtacgtacggtagaccggtaccgtagtaacgtttacggttttacgtacgttttacttcgtacgtacgtaggccgtaggtccggtcggtactacgggtccgtacccgttccggtttccccggtttaccgggttcccggtacccggtacggtaaccgtaacgggttcgtaaacttaccgaaccgtaaacgtcggttaacggtccgtacgtccgtaccctaaccgttcgttacgttaccgttacccttaccttccttccccggttaccc

SEQ ID NO: 149021 - DNA, 537 bp, Homo sapiens
  misc_feature: GYAE6OF01CICBK.10.63.F08.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccacctgtctttgctccaggggaaangccaccctntcctgcagggccagtcagagtgtttcccgntacttagcctggtaccaacagaagcctggccaggctcccaggctcctcatgtatgatgcatccaacgngggccactggcatcccagccaggttcagtcggcagtgggtcngcgacagacttcactctcacatcaacngacctagaacctgaagtatttnacttactttatttctgtactacagngtccgactactcggcctccgacgttcggaccgtacgggacctaagggtcggagacgtacgagacgtaacgtggtcggctcgccacctagtcttcgttcttacgacttccgttcccgtacc

SEQ ID NO: 149022 - DNA, 508 bp, Homo sapiens
  misc_feature: GYAE6OF01BIRMO.10.63.F08.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (373)..(373): a, c, t, g, unknown or other
  misc_feature (373)..(373): n is a, c, g, or t
  modified_base (497)..(497): a, c, t, g, unknown or other
  misc_feature (497)..(497): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaanagccaccctctcctgcagggccagtcagagtgtttcccgntacttagcctggtaccaacagaagcctggccaggctcccaggctcctcatgtatgatgcatccaacagggccactggcatcccagccaggttcaggtggcagtgggtctgcgacagacttcactctcaccatcaacngcctagacctgaagtatttgctactttatttctgttcacagagtcgcaactcgcctcgacgttcggccgtaggggaccaaggtggacgatcagacgaacgtgtggctcgcaccatctgtacttnacttctcccgc

SEQ ID NO: 149023 - DNA, 661 bp, Homo sapiens
  misc_feature: GYAE6OF01BVHQ3.10.63.F08.1.454.CMB.1.raw
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccgaggggaaagacgcccaccctctcctgcgagggccagtcagtagtcgtttcccgctacttacgcctaggtaccaacagaacgcctggccaggcctcccgaggcctcctcatgtatgatgcactaccaacgacgggccccgtggccgccccggagggtcggttcgaggtggcgtaggtgggtcgtgggacacggtacttcgactcctcaccatacgagcagtcctagacgacgtagtaagttgttttagacttaagttttatacgtgttacgagtcgtaagtccggtacgtcccgttacggttttccgggacgggtacgggtcgtacccgtacggtttcggggacgggtaaccgggaaacctaaaggtacggaacggtaacgaaaacggtacgttacgggtcggtacgtacggacaccgttacttacgttccggtttacctttactacccgtttcccttccccggtccttaaccg

SEQ ID NO: 149024 - DNA, 702 bp, Homo sapiens
  misc_feature: GYAE6OF01EP6YL.10.63.F08.1.454.CMB.1.raw
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagcctaccttgttctttgtcctccgaaggggaaagacgcccaccctctcctgcgacgggcctagtcagacgttcgttcccgcttacttacgcctacggtaccaacgagaacgtcctggacccacggccctaccgaggtcccttccgtctagttgtactggatacggactacgtacccgaacggtaccgggaccctacggtcgggaccctacgtccccgaaggtcccgtaaggtttccgacgggtacggtcggtagggttcggggtctcggtaccgaacgtacgtacctttaccaccgttcctacaacctaacgttacaaaccgtcgtacctaacgtacctaggtaactttctttacgtacttactttactttaccgtagtaccctaacgtacgtcgtacgtaccgtaacgtcgcccgttacggaccggttcggaccggtacgggtaacgagggtcgagtacgttacgacgtaccgaagttcggcgtcgacgtccacgttcttacgttcgttccttaccaccgtttcctcccggtac

SEQ ID NO: 149025 - DNA, 802 bp, Homo sapiens
  misc_feature: GYAE6OF01CRLGA.10.63.F08.1.454.CMB.1.raw
  modified_base (201)..(201): a, c, t, g, unknown or other
  misc_feature (201)..(201): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactccgcagtaaattgtgttgacacagtcctccagcctaccctgttctttgtctccgaaggggaaancgcccaccctctcctgcgacgggccaggtcaaggtcgttcgtttcccgcttaacttacgcccttaggtaacccaaacaggaacgccgttcggacccgtaagggcccttcccgaagggtcccttccctacctatgttattaggatcgactactaccgaacgacggggcccaacgtcggacctaaccgccccagcccgtaaggttccaaggtcggactacggttcgggtctcggacgaacgtaagtccttacacctttacctaccaacctacttaacccgaaacgtaccggtaacccttaaacgaacccgttaaggtaaacggtttattttttaacccggaactttttaaccgtttttaacttttaccgtacgttaaccgtaacccggttaagtaaccggttccctaacccggttaaacgttcccgggttaccccgtacgggtacccggtttcccgggaaccggtacgggggtaacccgtaaagggttcgggaacgtaacggtaacccgtaaacggaaccgttagtcgggttcggacgttaccgacctaacccgtagtttccgtccggtttactacccgttctttcccccgtaccgttacccg

SEQ ID NO: 149026 - DNA, 730 bp, Homo sapiens
  misc_feature: GYAE6OF01B0XJA.10.63.F08.1.454.CMB.1.raw
  modified_base (415)..(415): a, c, t, g, unknown or other
  misc_feature (415)..(415): n is a, c, g, or t
  modified_base (724)..(724): a, c, t, g, unknown or other
  misc_feature (724)..(724): n is a, c, g, or t
tcagcatagtagtgcacgaccggtgctcgatttagcgatcgtataagggggagaactgctcagttaggacccagagggaaccatggaagccccagctcagcttctcttcctcctgctactctggctcccagaaactaccgcagaaattgtgttgacacagtctccagcccaccctgttctttgtctccgaggggaaagcgccaccctctcctgccgacgggccagtcagagttcgttcccgctacttacgcctacggtaaccaacgagaacgcccgtggacccacggcctacccagaccttcctcatcctcgtaggtgactagtccgttcggacgggtccctacggtcggtaccgtcccgagtaccgtagggttcacggttcgggcgtagggtcgggttacgtacgggtaaacgngggtaccgtttccaaccttccgtaccaaccgtacgtaccgccgggaccggtcccctagggaccctaacggttccgttagggttaaacgttagttttacggtactttaacgttttaacgtttacgttacgttacgtaacgtacgtaagttaattaagtttacgtacggttttaggtttactttaccgttacggtttcccggaccggttacgggtaacgttaacgggttgtacgttacgaacgttaacgtaccgttgggtacgcgtacgaccgtactcttcgttacttccttacgactttcccctacccgntacccg

SEQ ID NO: 149027 - DNA, 502 bp, Homo sapiens
  misc_feature: GYAE6OF02I2KJ3.10.63.F08.1.454.CMB.1.raw
  modified_base (168)..(168): a, c, t, g, unknown or other
  misc_feature (168)..(168): n is a, c, g, or t
  modified_base (486)..(486): a, c, t, g, unknown or other
  misc_feature (486)..(486): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccanccaccctgtctttgtctccaggggaaagagccaccctctcctgcagggccagtcagagtgtttcccgctacttagcctggtaccaacagaagcctggccaggctcccaggctcctcatgtatgatgcatccaacagggccatggtatctcaggcaggttccgtggcaggtgggtctggggacagagtttcactgtcaccatcagcagcctgcagtctgaagtattttgctagtttattacttgtcagtcagtataatagctcggcccgcgacgttcgccgaagggccgaggtgaacgttcaacgactggtgctgcacntctgtctcatctccgc

SEQ ID NO: 149028 - DNA, 500 bp, Homo sapiens
  misc_feature: GYAE6OF02FRR1F.10.63.F08.1.454.CMB.1.raw
tcagcatagtagtgcacgaccggtgctcgatttagcgatcgtataagggggaggaactgctcagttaggacccagagggaaccatggaagccccagctcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttatactgtcagcagtatcataactggcctcgtggacgttcggccaaggaccaaggtcgacctcgaacgactggtggctgcaccatcgtgtcttcatctcccg

SEQ ID NO: 149029 - DNA, 548 bp, Homo sapiens
  misc_feature: GYAE6OF02GWASQ.10.63.F08.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (374)..(374): a, c, t, g, unknown or other
  misc_feature (374)..(374): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgtttcccgntacttagcctggtaccaacagaagcctggccaggctccaggctcctcatgtatgatgcatccaacgagggcccactggcatcccagccaggttcagtggcaggtgggtctgcgacagacttcactctcaccatccaacncgacctaagaacctagaagtatttgactactttatttctgtcacctagacgtcgctaactcggcctccggtacgttccggaccgacggggaccgaagggtcggagacgtcgaacggacgtaacgtggtcggactcgaccacctagtctcgttccttcgtacttccttcccgacc

SEQ ID NO: 149030 - DNA, 509 bp, Homo sapiens
  misc_feature: GYAE6OF02F86C0.10.63.F08.1.454.CMB.1.raw
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagtattttgctactttatttctgtcacctagagtcgcaactcggcctccgacgttcggccaggggaccaagggtgagatcagacgtaactggtggctgcaccatctcgtcttcattcctccgcc

SEQ ID NO: 149031 - DNA, 600 bp, Homo sapiens
  misc_feature: GYAE6OF02IWFVD.10.63.F08.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgtttcccgntacttagcctggtaccaacagaagcctggccaggctcccaggctcctcatgtatgatgcatccaacngggccactggcatcccagccaggttcagtgcagtgggtctgcganagacttcactctcaccatccaacncgcctaacgaacctgaagtatttgctactttatttctcgtcactagacgtcgactaacgtcggaccctccggtaccggtttccggacccggtaacgggggtacccgaaacggggttacgggaacggtacgtacgaacggaccgtaaacgttcgggtcgggtccgttacggaccctaaccgtacgttaccgttcggttccttaccgtactttcccgttaccccggtaccc

SEQ ID NO: 149032 - DNA, 733 bp, Homo sapiens
  misc_feature: GYAE6OF02JMGEZ.10.63.F08.1.454.CMB.1.raw
  modified_base (148)..(148): a, c, t, g, unknown or other
  misc_feature (148)..(148): n is a, c, g, or t
  modified_base (196)..(196): a, c, t, g, unknown or other
  misc_feature (196)..(196): n is a, c, g, or t
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
tcagcatagtagtgcacgaccggtgctcgatttagcgatcgtataagggggaggaactgctcagttaggacccagagggaaccatggaagccccagctcagcttctcttcctctgctactctggctccagaactaccgcagaaattgngttgacacagtctccagcccaccctgtctttgtctaccgaggggaaangccaccctctccgtgccagggccagtccagtagttcgtttcccgnttacttacgccttaggtaccaatagaacgcctgggccaggcctcccaggtctcctnatcgtatgatgctatccaacgacggcctagtcggaccacgtccccagccgaggttcaggtcggactagggtcgggttcaggaccgaacgtagtaccgttcaacttccgtaccaaccgtagtacccaaacgtaccgtacccgtaacgtaaaccgtacggtaaacgttacgttttacggtacttaacctttttacggtttaccttaccggttaacacccgtttaaaggacgttcccggtaaacgtaacccggttacgggtccccgttaaccggttacccggttacccgggacccggtaacgggggtacccctaaaggggttccgggtaaacgacgtacgtaccggtaacgtaacggtcgtcgggaccttaggaaccccgtacgtaactttccggtacggtacctttaacccggttcctaccccggtttccctaacccg

SEQ ID NO: 149033 - DNA, 541 bp, Homo sapiens
  misc_feature: GYAE6OF02F9NAQ.10.63.F08.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (379)..(379): a, c, t, g, unknown or other
  misc_feature (379)..(379): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaatttgtgttgacacagtctccagccaccctgtctttgtctccaggggaaangccaccctntcctgcagggccagtcagagtgttcgcacttcgttagggtgtatcaacataaatccggcaggctcccaggctcctcatctttgatgtctttcaacagggcccctggcgtcccaggcaggttcagtgcagtgggtctggggacagtacttcactctcacatcagcagcctagcncctgagtattttgctagtttattactgtcagctagtcgtgtcctacgttcgggcggtaggtcgccgtacgtttcgggacgggacgggaccaaagtacgacggtacaaacgtactggtaggctcgacaccgtacgtcttgtccttcacttcttcccgctactc

SEQ ID NO: 149034 - DNA, 712 bp, Homo sapiens
  misc_feature: GYAE6OF02G17NQ.10.63.F08.1.454.CMB.1.raw
  modified_base (195)..(195): a, c, t, g, unknown or other
  misc_feature (195)..(195): n is a, c, g, or t
  modified_base (441)..(441): a, c, t, g, unknown or other
  misc_feature (441)..(441): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccacctgtctttgctccgaggggaaangccaccctctcctgcagggccagtcagagttcgttcccgctacttagccttggtaccaacgagaacgccgtggccaggccgttcccgggctcctcatcgtatgatgacatcccgaagcgggcccagtcgggctactcccagaccaggtttccaggtgggcaggttgggtctggacgactagacctttcgacttctaccaacctatacccaaccgagtaccctaacggtaaaccctggtaaacgttnttttacggacttaacgttttatttccgttacgtcctaaccgtaaggtaccgttccgtaacctaaccggttcggtccccgttaaccggttcccgggttaccgggaccggtaacgggggaaccctaaaggggttcgggaagttaccgtaaccggaacggtaccggtaacgttcggtacgggtaccgtccggtaaccgtaacccgttaacgtttccgttaaccgtttccttttacccgtaaccggttttccccgttaccccggtaccttacccg

SEQ ID NO: 149035 - DNA, 656 bp, Homo sapiens
  misc_feature: GYAE6OF02IARKH.10.63.F08.1.454.CMB.1.raw
  modified_base (196)..(196): a, c, t, g, unknown or other
  misc_feature (196)..(196): n is a, c, g, or t
tcagcatagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaangccaccctctcctgcagggccagtcagagtgttccccgctacttagcctggtaccaacagaagcctggccaggcctcccaggctcctcatgtatgatgcatccaacgcgggccacgtggaccacgtccccagcccgtagggtttcaggtgggacctaggttcggggtcctggacgaaccgacggtaccttccgaacttctaccacctaatacccaaacgacgtacctaacgaacccgtagaatagttttcgacttactttatttccgttgtacctacctaggtacgtccgtacaaccggtcggtcccgttccggtaccggttaccgggaccggtaaccggggtaaccgtaacggggttagggaacgtagtacgaacgacgtaacggttcggtcgggtacgtacggaccgtaccgacgtttcgtacgtttccgttactacgtttccccgttcccgtacccg

SEQ ID NO: 149036 - DNA, 717 bp, Homo sapiens
  misc_feature: GYAE6OF02H42AI.10.63.F08.1.454.CMB.1.raw
  modified_base (379)..(379): a, c, t, g, unknown or other
  misc_feature (379)..(379): n is a, c, g, or t
  modified_base (566)..(566): a, c, t, g, unknown or other
  misc_feature (566)..(566): n is a, c, g, or t
  modified_base (640)..(640): a, c, t, g, unknown or other
  misc_feature (640)..(640): n is a, c, g, or t
  modified_base (663)..(663): a, c, t, g, unknown or other
  misc_feature (663)..(663): n is a, c, g, or t
  modified_base (688)..(688): a, c, t, g, unknown or other
  misc_feature (688)..(688): n is a, c, g, or t
tcagcatagtagtgcacgaccggtgctcgatttagcgatcgtataagggggaggaactgctcagttaggacccagagggaaccatggaagccccagctcagcttcctcttccctcctgctactctcggcctcccaagaaacctaccgcagtaaattgtgtgaacacagtctccagcccacctgttctttgtcctaccggaaggggaaacgacgccctaccctcctcctggcgacgggcctagtacaaggtaacttagttcgacctaacctaaaccttcggtacccttggtaactaccaaaaccgtaaaacggtcccgtacggacccgacgggtaccctaccctaacgtacctccctacgtaacttccgttcggtggtcnctaacgttccgtcggacgggtcctacggttcggccgtaccgacgtaccggtaggttacctagggtcggacgtcgggtacggtcgtaacggaacggtagtacgttcactcctaccgactagtcggacgtccggcctaggcctagtctaaggttattcgtttgactttatttatcgtgactaacggttnaagttaacagtttcgtacgtttttaggtactttaccggtccgttttaccggaaccgtttaggaactaacggttnttaacgtacgaaccgtaacggtnttcggaacttcgctaacccgtattnccgttattccgtatcttacccgccctacg
